US011180757B1

(12) United States Patent
Hinkle et al.

(10) Patent No.: US 11,180,757 B1
(45) Date of Patent: *Nov. 23, 2021

(54) 17β-HYDROXYSTEROID DEHYDROGENASE TYPE 13 (HSD17B13) IRNA COMPOSITIONS AND METHODS OF USE THEREOF

(71) Applicant: Regeneron Pharmaceuticals, Inc., Tarrytown, NY (US)

(72) Inventors: Gregory Hinkle, Plymouth, MA (US); Frederic Tremblay, Boston, MA (US); Noura S. Abul-Husn, New York, NY (US); Omri Gottesman, Rancho Santa Fe, CA (US); Alexander Li, White Plains, NY (US); Xiping Cheng, Northvale, NJ (US); Yurong Xin, Ashland, MA (US); Jesper Gromada, Concord, MA (US); Frederick E. Dewey, Winchester, MA (US); Aris Baras, Bedford Corners, NY (US); Alan Shuldiner, Baltimore, MD (US); Stuart Milstein, Arlington, MA (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/321,001

(22) Filed: May 14, 2021

Related U.S. Application Data

(63) Continuation of application No. 16/978,947, filed as application No. PCT/US2019/023079 on Mar. 20, 2019.

(60) Provisional application No. 62/645,941, filed on Mar. 21, 2018, provisional application No. 62/770,298, filed on Nov. 21, 2018, provisional application No. 62/775,590, filed on Dec. 5, 2018.

(51) Int. Cl.
*C12N 15/113* (2010.01)

(52) U.S. Cl.
CPC ...... *C12N 15/113* (2013.01); *C12N 2310/315* (2013.01); *C12N 2320/50* (2013.01)

(58) Field of Classification Search
None
See application file for complete search history.

(56) References Cited

U.S. PATENT DOCUMENTS

| 10,787,647 | B2 | 9/2020 | Abul-Husn et al. |
| 2003/0004102 | A1 | 1/2003 | Ashkenazi et al. |
| 2007/0219169 | A1 | 9/2007 | Becourt et al. |
| 2010/0028879 | A1 | 2/2010 | Labrie et al. |
| 2010/0056384 | A1 | 3/2010 | Hobbs et al. |
| 2018/0179553 | A1 | 6/2018 | Watson et al. |
| 2018/0216084 | A1 | 8/2018 | Abul-Husn et al. |
| 2018/0216104 | A1 | 8/2018 | Abul-Husn et al. |
| 2020/0354693 | A1 | 11/2020 | Abul-Husn et al. |

FOREIGN PATENT DOCUMENTS

| CN | 103520724 A | 1/2014 |
| CN | 104698108 A | 6/2015 |
| WO | WO 1995/029255 A1 | 11/1995 |
| WO | WO 1997/020942 A1 | 6/1997 |
| WO | WO 2004/110459 A1 | 12/2004 |
| WO | WO 2005/108415 A2 | 11/2005 |
| WO | WO 2010/028110 A2 | 3/2010 |
| WO | WO 2013/177060 A2 | 11/2013 |
| WO | WO 2013/190075 A2 | 12/2013 |
| WO | WO 2017/048620 A1 | 3/2017 |
| WO | WO 2018/136702 A1 | 7/2018 |
| WO | WO 2018/136758 A1 | 7/2018 |
| WO | WO 2019/183164 A1 | 9/2019 |
| WO | WO 2019/183329 A1 | 9/2019 |
| WO | WO 2020/061177 A1 | 3/2020 |

OTHER PUBLICATIONS

"Regeneron and Alnylam Pharmaceuticals Announce Collaboration to Discover New Treatments for Nonalcoholic Steatohepatitis (NASH)," PRNewswire, pp. 1-3, rerieved from the Internet: https://Investor.regeneron.com/node/12946/pdf on Jan. 14, 2020 entire document (Mar. 21, 2018).
Abul-Husn, et al., "A Protein-Truncating HSD17B13 Variant and Protection from Chronic Liver Disease," The New England Journal of Medicine, 378(12): 1096-1106, (Mar. 22, 2018).
Adam, et al., "Hydroxysteroid (17β) dehydrogenase 13 deficiency triggers hepatic steatosis and inflammation in mice," The FASEB Journal, vol. 32:Epub ahead of print (Jan. 31, 2018).
Altschul, et al., "Basic Local Alignment Search Tool," J. Mol. Biol., 215(3):403-410, (1990).
Altschul, et al., "Gapped BLAST and PSI-BLAST: a new generation of protein database search programs," Nucleic Acids Res., 25(17):3389-3402, (1997).
Brantly, et al. "Molecular basis of alpha-1-antitrypsin deficiency," Am. J. Med., 84(6A):13-31, (1988).
Brasaemle, et al., "Isolation of Lipid Droplets from Cells by Density Gradient Centrifugation," Curr. Protoc. Cell Biol., 3.15.1-3.15.12, (2005).
Browning, et al., "Prevalence of Hepatic Steatosis in an Urban Population in the United States: Impact of Ethnicity," Hepatology, 40(6):1387-1395, (2004).
Business Wire, "Arrowhead Pharmaceuticals Initiates Phase 1/2 Study of ARO-HSD in Normal Healthy Volunteers and Patients with NASH of Suspected NASH", Mar. 3, 2020, pp. 1-2. businesswire.com/news/home/20200303005396/en/Arrowhead-Pharmaceuticals-Initiates-Phase-12-Study-ARO-HSD.

(Continued)

*Primary Examiner* — Tracy Vivlemore
(74) *Attorney, Agent, or Firm* — Yongjin Choi; Alston & Bird LLP

(57) ABSTRACT

The invention relates to double-stranded ribonucleic acid (dsRNA) compositions targeting the HSD17B13 gene, as well as methods of inhibiting expression of HSD17B13, and methods of treating subjects that would benefit from reduction in expression of HSD17B13, such as subjects having a HSD17B13-associated disease, disorder, or condition, using such dsRNA compositions.

30 Claims, 2 Drawing Sheets

Specification includes a Sequence Listing.

(56) References Cited

OTHER PUBLICATIONS

Chambers, et al., "Genome-wide association study identifies loci influencing concentrations of liver enzymes in plasma," Nature Genetics, 43(11), 1131-1138 plus Online Methods and Supplementary Materials (Nov. 2011).
Cohen, et al., "Human Fatty Liver Disease: Old Questions and New Insights," Science, 332(6037):1519-1523, (2011).
Denny, et al., "PheWAS: demonstrating the feasibility of a phenome-wide scan to discover gene—disease associations," Bioinformatics, 26(9):1205-1210, (2010).
Denny, et al., "Systematic comparison of phenome-wide association study of electronic medical record data and genome-wide association study data," Nat. Biotechnol., 31(12):1102-1110, (2013).
Dewey, et al. "Distribution and clinical impact of functional variants in 50,726 whole-exome sequences from the DiscovEHR Study," Science, 354(6319): aaf6814, (2016).
Ding, et al., "Isolating lipid droplets from multiple species," Nat. Protoc., 8(1):43-51, (2013).
Edelman, et al., "Genetic analysis of nonalcoholic fatty liver disease within a Caribbean-Hispanic population," Mol. Genetic. Genomic Med., 3(6):558-569, (2015).
Feitosa, et al., "The ERLIN1-CHUK-CWF19L1 gene cluster influences liver fat deposition and hepatic inflammation in the NHLBI Family Heart Study," Atherosclerosis, 218(1): 175-180, (2013).
Ford, et al., "A new Assay for Picomole Levels of Androsterone and Testosterone Using Co-immobilized Luciferase, Oxidoreductase, and Steroid Dehydrogenase," Analytical Biocehemistry, 110(1), 43-48, (1981).
GenBank: : Accession No. DR004209, "TC104687 Human liver, large insert, pCMV expression library Homo sapiens cDNA clone TC104687 5' similar to Homo sapiens similar to hydroxysteroid (17-beta) dehydrogenase 11; hydroxysteroid 17-beta dehydrogenase 11 (LOC205983), mRNA sequence," submitted Jan. 2011. [Retrieved from the Internet Jun. 10, 2019: <URL: ncbi.nlm.nih.gov>].
Ghanbari, et al., "Genetic Variations in MicroRNA-Binding Sites Affect MicroRNA-Mediated Regulation of Several Genes Associated With Cardio-metabolic Phenotypes," Circ. Cardiovasc. Genet., 8(3):473-486, (2015).
Gieger, et al., "New gene functions in megakaryopoiesis and platelet formation," Nature, 480(7376): 201-208 plus Supplementary Information, (Apr. 24, 2012).
Hotta, et al., "Association of the rs738409 polymorphism in PNPLA3 with liver damage and the development of nonalcoholic fatty liver disease," BMC Med. Genet., 11:172, (2010).
Huang, et al., "Expression and Characterization of a PNPLA3 Protein Isoform (1148M) Associated with Nonalcoholic Fatty Liver Disease," J. Biol. Chem., 286(43):37085-37093, (2011).
Kahali, et al., "Insights from Genome-Wide Association Analyses of Nonalcoholic Fatty Liver Disease," Semin. Liver Dis., 35(4):375-391, (2015).
Kampf, et al., "The human liver-specific proteome defined by transcriptomics and antibody-based profiling," The FASEB Journal, vol. 28:2901-2914, (Jul. 2014).
Kitamoto, et al., "Genome-wide scan revealed that polymorphisms in the PNPLA3, SAMM50, and PARVB genes are associated with development and progression of nonalcoholic fatty liver disease in Japan," Hum. Genet., 132(7)783-792, (2013).
Kleiner, et al., "Design and Validation of a Histological Scoring System for Nonalcoholic Fatty Liver Disease," Hepatology, 41(6):1313-1321, (2005).
Kochanek, et al., "Deaths: Final Data for 2014," Natl. Viral Stat. Rep., 65(4): 1-122, (2016).
Kozltina, et al., "Exome-wide association study identifies a TM6SF2 variant that confers susceptibility to nonalcoholic fatty liver disease," Nat. Genet., 46(4):352-356, (2014).
Krazeisen, et al., "Phytoestrogens inhibit human 17β-hydroxysteroid dehydrogenase type 5," Molecular and Cellular Endocrinology, 171(1-2):151-162, (2001).
Lazo, et al., "Prevalence of Nonalcoholic Fatty Liver Disease in the United States: The Third National Health and Nutrition Examination Survey, 1988-1994," Am. J. Epidemiol., 178(1):38-45,(2013).
Leippe, et al., "Bioluminescent Nicotinamide Adenine Dinucleotide Detection Assays Part 1: Technology and Features," (2014), https://www.promega.com/resources/pubhub/bioluminescent-nicotinamide-adenine-dinucleotide-detection-assays/.
Li, et al. "LTB4 causes macrophage—mediated inflammation and directly induces insulin resistance in obesity," Nat. Med., 21 (3):239-247, (2015).
Li, et al., "Fast and accurate short read alignment with Burrows—Wheeler transform," Bioinformatics, 25(14):1754-1760, (2009).
Liu, et al., "Molecular cloning and expression analysis of a new gene for short-chain dehydrogenase/reductase 9," Acta Biochim. Pol., 54(1):213-218, (2007).
Liu, et al. "TM6SF2 rs58542926 influences hepatic fibrosis progression in patients with non-alcoholic fatty liver disease," Nat. Commun., 5:4309, pp. 1-6, (2014).
Mahdessian, et al., "TM6SF2 is a regulator of liver fat metabolism influencing triglyceride secretion and hepatic lipid droplet content," Proc. Natl. Acad. Sci. U.S.A., 111 (24):8913-8918, (2014).
McKenna, et al., "The Genome Analysis Toolkit: A MapReduce framework for analyzing next-generation DNA sequencing data," Genome Res., 20(9): 1297-1303, (2010).
Moeller, et al., "Integrated view on 17beta-hydroxysteroid dehydrogenases," Molecular and Cellular Endocrinology, 301:7-19, (2009).
Moeller, et al., "Multifunctionality of human 17β-hydroxysteroid dehydrogenases," Mol. Cell. Endocrinol., 248(1-2):47-55, (2006).
Morgan, et al., "Eradication of Hepatitis C Virus Infection and the Development of Hepatocellular Carcinoma," Ann. Intern. Med., 158(5 Pt 1):329-337 and W-158-W-160, (2013).
NCBI Reference Sequence: NM_001136230, "Homo sapiens hydroxysteroid 17-beta dehydrogenase 13 (HSD17B13), transcript variant B, mRNA," pp. 1-5, (2017).
NCBI Reference Sequence: NM_178135, "Homo spiens hydroxysteroid 17-beta dehydrogenase 13 (HSD17B13), transcript variant A, mRNA," pp. 1-5, (2017).
NCBI Reference Sequence: NP_001129702, "17-beta-hydroxysteroid dehydrogenase 13 isoform B [Homo sapiens]," pp. 1-4, (2017).
NCBI Reference Sequence: NP_835236, "17-beta-hydroxysteroid dehydrogenase 13 isoform a precursor [Homo sapiens]," pp. 1-4, (2017).
New England Biolabs Catalog (1998/1999), pp. 121 and 284, (1998).
NP Cluster Report rs72613567, [Retrieved from the Internet Jun. 6, 2019 <URL: ncbi.nlm.nig.gov>].
Oniki, et al., "Influence of the PNPLA3 rs738409 Polymorphism on Non-Alcoholic Fatty Liver Disease and Renal Function among Normal Weight Subjects," PLoS One, 10(7):e0132640, (2015).
Pirazzi, et al., "Patatin-ike phospholipase domain-containing 3 (PNPLA3) 1148M (rs738409) affects hepatic VLDL secretion in humans and in vitro," J. Hepatol., 57(6):1276-1282, (2012).
Promega, "Technical Manual: NAD(P)H-Glo Detection System," TM398, pp. 1-15, (2017).
Pruim, et al., "LocusZoom: regional visualization of genome-wide association scan results," Bioinformatics, 26(18):2336-2337, (2010).
Quadri, et al., "Mutations in SLC30A10 Cause Parkinsonism and Dystonia with Hypermanganesemia, Polycthemia, and Chronic Liver Disease," The American Journal of Human Genetics, 90:467-477 plus Supplemental Material, (Mar. 9, 2012).
Ratziu, et al., "Current efforts and trends in the treatment of NASH," Journal of Hepatology, 62:S65-S75, (2015).
Reid, et al., "Launching genomics into the cloud: deployment of Mercury, a next generation sequence analysis pipeline," BMC Bioinformatics, 15:30, pp. 1-11, (2014).
Romeo, et al., "Genetic variation in PNPLA3 confers susceptibility to nonalcoholic fatty liver disease," Nat. Genet., 40(12):1461-1465, (2008).
Rotman, et al., "The Association of Genetic Variability in PNPLA3 with Histological Severity of Non-Alcoholic Fatty Liver Disease," Hepatology, 52(3):894-903, (2010).

(56) References Cited

OTHER PUBLICATIONS

Santa Cruz Biotechnology, "17β-HSD13 Antibody (K-14): sc-161285" [Retrieved from the Internet Jun. 1, 2016: <www.scbt.com/datasheet-161285-17betahsd13-k-14-antibody.html>].

Santa Cruz Biotechnology, "17β-HSD13 siRNA (m), shRNA and Lentiviral Particle Gene Silencers" [Retrieved from the Internet Jun. 1, 2016: <www.scbt.com/datasheet-108263-17beta-hsd13-sima-m.html>].

Sato, et al., "Highly specific delivery of siRNA to hepatocytes circumvents endothelial cell-mediated lipid nanoparticle-associated toxicity leading to the safe and efficacious decrease in the hepatitis B virus," J. Control. Release, 266:216-225, (2017).

Schiavinato, et al., "EMILIN-3, peculiar member of elastin microfibril interface-located protein (EMILIN) family, has distinct expression pattern, forms oligomeric assemblies, and serves as transforming growth factor β (TGF-β) antagonist," J. Biol. Chem., 287(14): 11498-11515, (2012).

Shen, et al., "The rs738409 (I148M) variant of the PNPLA3 gene and cirrhosis: a meta-analysis," J. Lipid Res., 56(1):167-175, (2015).

Sivan et al., "Identification of Restriction Factors by Human Genome-Wide RNA Interference Screening of Viral Host Range Mutants Exemplified by Discovery of SAMD9 and WDR6 as Inhibitors of the Vaccinia Virus K1L-C7L-Mutant," MBio 6(4):e01122, (2015).

Sivan et al., "Identification of Restriction Factors by Human Genome-Wide RNA Interference Screening of Viral Host Range Mutants Exemplified by Discovery of SAMD9 and WDR6 as Inhibitors of the Vaccinia Virus K1L-C7L-Mutant," MBio 6(4):e01122, Supplemental Material, (2015).

Smagris, et al., "Inactivation of Tm6sf2, a Gene Defective in Fatty Liver Disease, Impairs Lipidation but Not Secretion pf Very Low Density Lipoproteins," J. Biol. Chem., 291(20:10659-10676, (2016).

Smith, et al., "Comparison of Biosequences," Advances in Applied Mathematics, 2:482-489, (1981).

Sookoian, et al., "A nonsynonymous gene variant in the adiponutrin gene is associated with nonalcoholic fatty liver disease severity," J. Lipid Res., 50(10):2111-2116, (2009).

Sookoian, et al., "Genetic Variation in Transmembrane 6 Superfamily Member 2 and the Risk of Nonalcoholic Fatty Liver Disease and Histological Disease Severity," Hepatology, 61(2):515-525, (2015).

Speliotes, et al., "Genome-Wide Association Analysis Identifies Variants Associated with Nonalcoholic Fatty Liver Disease That Have Distinct Effects on Metabolic Traits," PLoS Genet., 7(3):e1001324, (2011).

Su et al., "Comparative proteomic study reveals 17β-HSD13 as a pathogenic protein in nonalcoholic fatty liver disease," Proc. Natl. Acad. Sci. U.S.A. 111(31):11437-11442, (2014).

Submitted SNP(ss) Report in Submission Format for NCBI Assay Id (ss#): ss557289122. Nov. 22, 2012, 1 printed page from www.ncbi.nlm.nih.gov/ (Year: 2012).

Tang, et al., "A mouse knockout library for secreted and transmembrane proteins," Nature Biotechnology, 28(7):749-755 plus Online Methods and Supplementary Information, (Jul. 2010).

Trepo, et al., "PNPLA3 gene in liver diseases," J. Hepatol., 65(2):399-412, (2016).

UniProtKB-Q7Z5P4-1, "17-beta-hydroxysteroid dehydrogenase 13," p. 6, (2003).

UniProtKB-Q7Z5P4-2, "17-beta-hydroxysteroid dehydrogenase 13," pp. 6-7, (2003).

Van Der Meer, et al., "Association Between Sustained Virological Response and All-Cause Mortality Among Patients With Chronic Hepatitis C and Advanced Hepatic Fibrosis," JAMA, 308(24):2584-2593, (2012).

Victor, et al., "The Dallas Heart Study: A Population-Based Probability Sample for the Multidisciplinary Study of Ethnic Differences in Cardiovascular Health," Am. J. Cardiol., 93(12):1473-1480, (2004).

Willer, et al., "METAL: fast and efficient meta-analysis of genomewide association scans," Bioinformatics, 26(17):2190-2191, (2010).

Williams, et al., "Prevalence of nonalcoholic fatty liver disease and nonalcoholic steatohepatitis among a largely middle-aged population utilizing ultrasound and liver biopsy: a prospective study," Gastroenterology, 140(1):124-131, (2011).

Wong, et al., "Nonalcoholic Steatohepatitis Is the Second Leading Etiology of Liver Disease Among Adults Awaiting Liver Transplantation in the United States," Gastroenterology, 148(3):547-555, (2015).

Yang, et al., "GCTA: A Tool for Genome-wide Complex Trait Analysis," Am. J. Hum. Genet., 88(1):76-82, (2011).

Younossi, et al., "Changes in the Prevalence of the Most Common Causes of Chronic Liver Diseases in the United States From 1988 to 2008," Clin. Gastroenterol. Hepatol., 9(6):524-530, (2011).

Yuan, et al., "Population-Based Genome-wide Association Studies Reveal Six Loci Influencing Plasma Levels of Liver Enzymes," Am. J. Hum. Genet., 83(4):520-528, (2008).

Zhang et al., "Omic studies reveal the pathogenic lipid droplet proteins in non-alcoholic fatty liver disease", Protein Cell, 8(1):4-13, (2017).

Zhang, et al., "PowerBLAST: A New Network BLAST Application for Interactive of Automated Sequence Analysis and Annotation," Genome Res., 7(6):649-656, (1997).

PCT Application No. PCT/US2619/023079, PCT International Search Report and Written Opinion of the International Searching Authority dated Jun. 26, 2019.

U.S. Appl. No. 16/157,503, Non-Final Office Action dated Jun. 12, 2020.

Kitamoto, et al., "Association of polymorphisms in GCKR and TRIB1 with nonalcoholic fatty liver disease and metabolic syndrome traits," Endocr. J., 61(7):683-689, (2014).

Hassan, et al., "Nonalcoholic fatty liver disease: A comprehensive review of a growing epidemic," World J. Gastroenterol., 20(34):12082-12101. (Sep. 14, 2014).

17β-HYDROXYSTEROID DEHYDROGENASE TYPE 13 (HSD17B13) IRNA COMPOSITIONS AND METHODS OF USE THEREOF

RELATED APPLICATIONS

This application is a continuation application of U.S. application Ser. No. 16/978,947, filed Sep. 8, 2020, which is a 35 U.S.C. § 371 national stage filing of International Application No. PCT/US2019/023079, filed Mar. 20, 2019, which in turn claims the benefit of priority to U.S. Provisional Application No. 62/645,941, filed on Mar. 21, 2018, U.S. Provisional Application No. 62/770,298, filed on Nov. 21, 2018, and U.S. Provisional Application No. 62/775,590, filed on Dec. 5, 2018. The entire contents of each of the foregoing provisional patent applications are incorporated herein by reference.

SEQUENCE LISTING

The instant application contains a Sequence Listing which has been submitted electronically in ASCII format and is hereby incorporated by reference in its entirety. Said ASCII copy, created on May 12, 2021, is named 557782SEQLIST.txt and is 1,374,120 bytes in size.

BACKGROUND OF THE INVENTION

17β-hydroxysteroid dehydrogenase Type 13 (HSD17B13) is a member of the 17β-Hydroxysteroid dehydrogenase (HSD17B) family of enzymes whose members have various functions, including, for example, reduction or oxidation of sex hormones, fatty acids, and bile acids in vivo (Moeller and Adamski (2009) *Mol Cell Endocrinol* 301:7). Members of the HSD17B family differ in tissue distribution, subcellular localization, catalytic preference, and have diverse substrate specificities as they also catalyze the conversions of other substrates than steroids, as for example lipids and retinoids (Marchais-Oberwinkler, et al. (2011) *J Steroid Biochem Mol Biol* 125(1-2):66-82). HSD17B13 has been demonstrated to enhance hepatic lipogenesis in normal mouse liver and cultured human hepatocytes (Su, et al. (2014) *Proc Natl Acad Sci USA* 111:11437).

Hepatocytes, which form the parenchymal tissue of the liver, are responsible for mobilizing lipids for energy and storing excess lipids in the form of lipid droplets (LDs) making the liver the primary organ responsible for lipid homeostasis.

LDs are now recognized as bioactive organelles involved in lipid metabolism, membrane traffic and signal transduction. LDs are generally composed of a core of neutral lipids (such as triacylglycerols (TGs) and cholesterol esters surrounded by a phospholipid/cholesterol monolayer. Numerous LD-specific proteins associate with the membrane of LDs and function, e.g., to control the flux of molecules into and out of the LDs. The predominant hepatocellular LD-associated proteins are members of the perilipin family of proteins, but non-perilipin proteins, such as hypoxia-inducible protein 2 (HIG2), patatin-like phospholipase domain-containing 3 (PNPLA3), and HSD17B13, have also been identified as LD-associate proteins (Carr and Ahima (2016) *Exp Cell Res* 15:187; Su, et al. (2014) *Proc Natl Acad Sci USA* 111:11437).

Increased accumulation of LDs is associated with many metabolic diseases and chronic fibro-inflammatory liver diseases, such as liver fibrosis, NASH and NAFLD. HSD17B13 has been identified as one of the most abundantly expressed LD proteins specifically localized on the surface of LDs in human subjects and mice with NAFLD. The level of expression of HSD17B13 was also shown to be up-regulated in the livers of patients and mice with NAFLD. Overexpression of HSD17B13 resulted in an increase in the number and size of LDs. Hepatic overexpression of HSD17B13 in C57BL/6 mice significantly increased lipogenesis and TG contents in the livers, leading to a fatty liver phenotype.

There is currently no treatment for chronic fibro-inflammatory liver diseases. The current standard of care for subjects having a chronic fibro-inflammatory liver disease includes, lifestyle modification and managing the associated comorbidities, e.g., hypertension, hyperlipidemia, diabetes, obesity, etc. Accordingly, as the prevalence of chronic fibro-inflammatory liver diseases has progressively increased over the past 10 years and is expected to increase, there is a need in the art for alternative treatments for subjects having a chronic fibro-inflammatory liver disease.

SUMMARY OF THE INVENTION

The present invention provides iRNA compositions which effect the RNA-induced silencing complex (RISC)-mediated cleavage of RNA transcripts of a 17β-hydroxysteroid dehydrogenase Type 13 (HSD17B13) gene. The HSD17B13 gene may be within a cell, e.g., a cell within a subject, such as a human. The present invention also provides methods of using the iRNA compositions of the invention for inhibiting the expression of a HSD17B13 gene and/or for treating a subject who would benefit from inhibiting or reducing the expression of a HSD17B13 gene, e.g., a subject suffering or prone to suffering from an HSD17B13-associated disease, for example, a chronic fibro-inflammatory liver disease.

Accordingly, in one aspect, the present invention provides a double stranded ribonucleic acid (dsRNA) agent for inhibiting expression of 17β-hydroxysteroid dehydrogenases type 13 (HSD17B13) in a cell. The dsRNA agent includes a sense strand and an antisense strand, wherein the sense strand comprises at least 15 contiguous nucleotides differing by no more than 1, 2, or 3 nucleotides from the nucleotide sequence of SEQ ID NO:1 or 2 and the antisense strand comprises at least 15 contiguous nucleotides differing by no more than 1, 2, or 3 nucleotides from the nucleotide sequence of SEQ ID NO:8 or 9. In some embodiments, the dsRNA agent includes a sense strand and an antisense strand, wherein the sense strand comprises at least 15 contiguous nucleotides from the nucleotide sequence of SEQ ID NO:1 or 2 and the antisense strand comprises at least 15 contiguous nucleotides from the nucleotide sequence of SEQ ID NO:8 or 9.

In another aspect, the present invention provides a double stranded ribonucleic acid (dsRNA) agent for inhibiting expression of 17β-hydroxysteroid dehydrogenases type 13 (HSD17B13) in a cell. The dsRNA agent includes a sense strand and an antisense strand forming a double stranded region, wherein said antisense strand comprises a region of complementarity to an mRNA encoding HSD17B13 which comprises at least 15 contiguous nucleotides differing by no more than 1, 2, or 3 nucleotides from any one of the antisense sequences listed in any one of Tables 2, 3, 7, 8, 10, 11, or 13. In some embodiments, the dsRNA agent includes a sense strand and an antisense strand forming a double stranded region, wherein said antisense strand comprises a region of complementarity to an mRNA encoding HSD17B13 which comprises at least 15 contiguous nucleotides from any one of the antisense sequences listed in any one of Tables 2, 3, 7, 8, 10, 11, or 13.

In one embodiment, the region of complementarity comprises at least 15 contiguous nucleotides differing by no more than 1, 2, or 3 nucleotides from any one of nucleotides 213-242; 256-287; 361-385; 447-480; 483-529; 489-529; 630-653; 688-711; 752-777; 753-779; 772-806; 781-806; 791-851; 829-858; 870-896; 893-930; 900-930; 910-932; 980-1092; 1101-1158; 1176-1210; 1320-1350; 1335-1373; 1456-1482; 1506-1535; 1558-1588; 1699-1740; 1725-1757; 2182-2210; 2190-2254; 2194-2216; 2240-2373; or 2242-2264 of SEQ ID NO:1. In some embodiments, the region of complementarity comprises at least 15 contiguous nucleotides from any one of nucleotides 213-242; 256-287; 361-385; 447-480; 483-529; 489-529; 630-653; 688-711; 752-777; 753-779; 772-806; 781-806; 791-851; 829-858; 870-896; 893-930; 900-930; 910-932; 980-1092; 1101-1158; 1176-1210; 1320-1350; 1335-1373; 1456-1482; 1506-1535; 1558-1588; 1699-1740; 1725-1757; 2182-2210; 2190-2254; 2194-2216; 2240-2373; or 2242-2264 of SEQ ID NO:1.

In another embodiment, the region of complementarity comprises at least 15 contiguous nucleotides differing by no more than 1, 2, or 3 nucleotides from any one of nucleotides 71-93, 101-123, 108-130, 109-131, 112-134, 123-145; 213-235; 220-242, 256-278; 292-314, 293-315, 299-321, 301-323, 324-346, 349-371, 350-372, 351-373, 352-374; 353-375, 355-377, 356-378, 357-379, 361-383; 363-385, 365-387, 402-424, 422-444, 423-445, 427-449, 428-450, 431-453, 447-469, 489-511, 490-512, 507-529, 541-563, 547-569, 548-570, 585-607, 589-611, 592-614, 593-615, 620-642, 630-652, 631-653, 632-654, 649-671, 676-698, 688-710, 723-745, 728-750, 752-774, 753-775, 755-777, 757-779, 763-785, 764-786, 772-794, 778-800, 780-802, 781-803, 791-813, 792-814, 794-816, 795-817, 807-829, 828-850, 829-851; 832-854; 836-858; 838-860; 839-861, 840-862, 832-861; 870-892, 874-896, 894-916, 895-917; 896-918; 897-919; 898-920; 899-921; 900-922; 901-923; 902-924; 906-928; 908-930; 894-930; 910-932; 965-987; 966-988981-1003; 1005-1027; 1006-1028; 1010-1032; 1005-1032; 1052-1074; 1097-1119; 1101-1123; 1102-1124; 1103-1125; 1133-1155; 1135-1157; 1136-1158; 1097-1125; 1133-1158; 1176-1198; 1188-1210; 1243-1265; 1315-13371320-1342; 1322-1344; 1325-1347; 1327-1349; 1328-1350; 1320-1507; 1335-1357; 1336-1358; 1458-1480; 1459-1481; 1460-1482; 1458-1482; 1497-1519; 1498-1520; 1506-1528; 1513-1535; 1565-1587; 1566-1588; 1613-1635; 1614-1636; 1622-1644; 1643-1665; 1699-1721; 1717-1739; 1718-1740; 1724-1746; 1725-1747; 1726-1748; 1727-1749; 1728-1750; 1717-1750; 1737-1759; 1768-1790; 2188-2210; 2190-2212; 2188-2212; 2194-2216; 2195-2217; 2250-2272; 2232-2254; 2240-2262; 2232-2262; 2242-2264; 2245-2267 2249-2271; 2232-2271; 2347-2369; 2351-2373; or 2347-2373 of SEQ ID NO:1. In some embodiments, the region of complementarity comprises at least 15 contiguous nucleotides from any one of nucleotides 71-93, 101-123, 108-130, 109-131, 112-134, 123-145; 213-235; 220-242, 256-278; 292-314, 293-315, 299-321, 301-323, 324-346, 349-371, 350-372, 351-373, 352-374; 353-375, 355-377, 356-378, 357-379, 361-383; 363-385, 365-387, 402-424, 422-444, 423-445, 427-449, 428-450, 431-453, 447-469, 489-511, 490-512, 507-529, 541-563, 547-569, 548-570, 585-607, 589-611, 592-614, 593-615, 620-642, 630-652, 631-653, 632-654, 649-671, 676-698, 688-710, 723-745, 728-750, 752-774, 753-775, 755-777, 757-779, 763-785, 764-786, 772-794, 778-800, 780-802, 781-803, 791-813, 792-814, 794-816, 795-817, 807-829, 828-850, 829-851; 832-854; 836-858; 838-860; 839-861, 840-862, 832-861; 870-892, 874-896, 894-916; 895-917; 896-918; 897-919; 898-920; 899-921; 900-922; 901-923; 902-924; 906-928; 908-930; 894-930; 910-932; 965-987; 966-988981-1003; 1005-1027; 1006-1028; 1010-1032; 1005-1032; 1052-1074; 1097-1119; 1101-1123; 1102-1124; 1103-1125; 1133-1155; 1135-1157; 1136-1158; 1097-1125; 1133-1158; 1176-1198; 1188-1210; 1243-1265; 1315-13371320-1342; 1322-1344; 1325-1347; 1327-1349; 1328-1350; 1320-1507; 1335-1357; 1336-1358; 1458-1480; 1459-1481; 1460-1482; 1458-1482; 1497-1519; 1498-1520; 1506-1528; 1513-1535; 1565-1587; 1566-1588; 1613-1635; 1614-1636; 1622-1644; 1643-1665; 1699-1721; 1717-1739; 1718-1740; 1724-1746; 1725-1747; 1726-1748; 1727-1749; 1728-1750; 1717-1750; 1737-1759; 1768-1790; 2188-2210; 2190-2212; 2188-2212; 2194-2216; 2195-2217; 2250-2272; 2232-2254; 2240-2262; 2232-2262; 2242-2264; 2245-2267 2249-2271; 2232-2271; 2347-2369; 2351-2373; or 2347-2373 of SEQ ID NO:1.

In another embodiment, the region of complementarity comprises at least 15 contiguous nucleotides differing by no more than 1, 2, or 3 nucleotides from any one of nucleotides 108-130; 109-131; 108-131; 112-134; 293-315; 301-323; 293-323; 361-383; 402-424; 423-445; 428-450; 423-450; 428-453; 431-453; 489-511; 490-512; 489-512; 649-671; 753-775; 772-794; 791-813; 792-814; 795-817; 791-817; 829-851; 832-854; 836-858; 829-858; 870-892; 874-896; 870-896; 898-920; 900-922; 902-924; 906-928; 908-930; 902-930; 910-932; 966-988; 1328-1350; or 2194-2216; 2242-2264; or 2249-2271 of SEQ ID NO:1. In some embodiments, the region of complementarity comprises at least 15 contiguous nucleotides from any one of nucleotides 108-130; 109-131; 108-131; 112-134; 293-315; 301-323; 293-323; 361-383; 402-424; 423-445; 428-450; 423-450; 428-453; 431-453; 489-511; 490-512; 489-512; 649-671; 753-775; 772-794; 791-813; 792-814; 795-817; 791-817; 829-851; 832-854; 836-858; 829-858; 870-892; 874-896; 870-896; 898-920; 900-922; 902-924; 906-928; 908-930; 902-930; 910-932; 966-988; 1328-1350; or 2194-2216; 2242-2264; or 2249-2271 of SEQ ID NO:1. In another embodiment, the region of complementarity comprises at least 15 contiguous nucleotides differing by no more than 1, 2, or 3 nucleotides from nucleotides 898-930 of SEQ ID NO:1. In some embodiments, the region of complementarity comprises at least 15 contiguous nucleotides from nucleotides 898-930 of SEQ ID NO:1.

In one embodiment, the region of complementarity comprises at least 15 contiguous nucleotides differing by no more than 1, 2, or 3 nucleotides from nucleotides 910-932 of SEQ ID NO:1. In some embodiments, the region of complementarity comprises at least 15 contiguous nucleotides from nucleotides 910-932 of SEQ ID NO:1.

In one embodiment, the region of complementarity comprises at least 15 contiguous nucleotides differing by no more than 1, 2, or 3 nucleotides from nucleotides 2194-2216 of SEQ ID NO:1. In some embodiments, the region of complementarity comprises at least 15 contiguous nucleotides from nucleotides 2194-2216 of SEQ ID NO: 1.

In one embodiment, the region of complementarity comprises at least 15 contiguous nucleotides differing by no more than 1, 2, or 3 nucleotides from nucleotides 2242-2264 of SEQ ID NO:1. In some embodiments, the region of complementarity comprises at least 15 contiguous nucleotides from nucleotides 2242-2264 of SEQ ID NO: 1.

In one embodiment, the dsRNA agent comprises at least one modified nucleotide.

In one embodiment, substantially all of the nucleotides of the sense strand comprise a modification. In another embodiment, substantially all of the nucleotides of the antisense strand comprise a modification. In yet another embodiment, substantially all of the nucleotides of the sense strand and substantially all of the nucleotides of the antisense strand comprise a modification.

In one aspect, the present invention provides a double stranded ribonucleic acid (dsRNA) agent for inhibiting expression of 17β-hydroxysteroid dehydrogenases type 13 (HSD17B13) in a cell. The dsRNA agent includes a sense strand and an antisense strand forming a double stranded region, wherein the sense strand comprises at least 15 contiguous nucleotides differing by no more than 1, 2, or 3 nucleotides from the nucleotide sequence of SEQ ID NO:1 or 2 and the antisense strand comprises at least 15 contiguous nucleotides differing by no more than 1, 2, or 3 nucleotides from the nucleotide sequence of SEQ ID NO:8 or 9, wherein substantially all of the nucleotides of the sense strand and substantially all of the nucleotides of the antisense strand are modified nucleotides, and wherein the sense strand is conjugated to a ligand attached at the 3'-terminus. In some embodiments, the dsRNA agent includes a sense strand and an antisense strand forming a double stranded region, wherein the sense strand comprises at least 15 contiguous nucleotides from the nucleotide sequence of SEQ ID NO:1 or 2 and the antisense strand comprises at least 15 contiguous nucleotides from the nucleotide sequence of SEQ ID NO:8 or 9, wherein substantially all of the nucleotides of the sense strand and substantially all of the nucleotides of the antisense strand are modified nucleotides, and wherein the sense strand is conjugated to a ligand attached at the 3'-terminus.

In one embodiment, all of the nucleotides of the sense strand comprise a modification. In another embodiment, all of the nucleotides of the antisense strand comprise a modification. In yet another embodiment, all of the nucleotides of the sense strand and all of the nucleotides of the antisense strand comprise a modification.

In one embodiment, at least one of said modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O—(N-methylacetamide) modified nucleotide, and combinations thereof.

In one embodiment, the nucleotide modifications are 2'-O-methyl and/or 2'-fluoro modifications.

The region of complementarity may be at least 17 nucleotides in length; 19 to 30 nucleotides in length; 19-25 nucleotides in length; or 21 to 23 nucleotides in length.

Each strand may be no more than 30 nucleotides in length, e.g., each strand is independently 19-30 nucleotides in length; each strand is independently 19-25 nucleotides in length; each strand is independently 21-23 nucleotides in length.

The dsRNA may include at least one strand that comprises a 3' overhang of at least 1 nucleotide; or at least one strand that comprises a 3' overhang of at least 2 nucleotides.

In some embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is

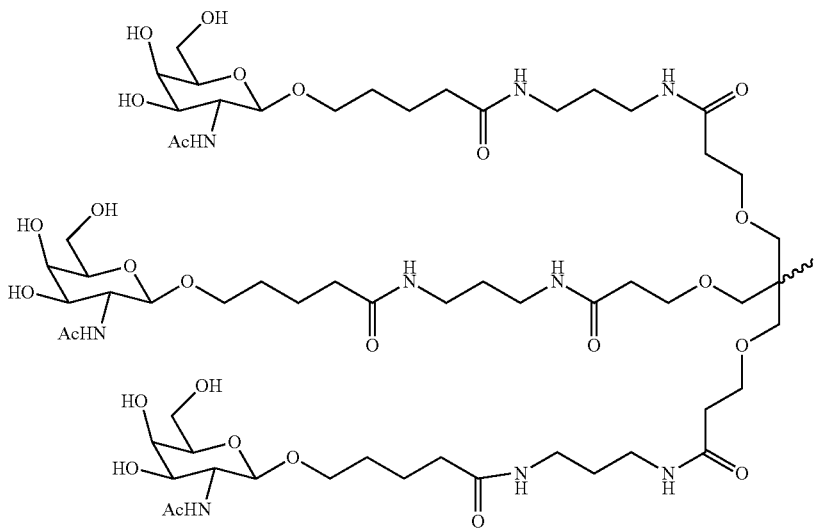

In one embodiment, the dsRNA agent is conjugated to the ligand as shown in the following schematic

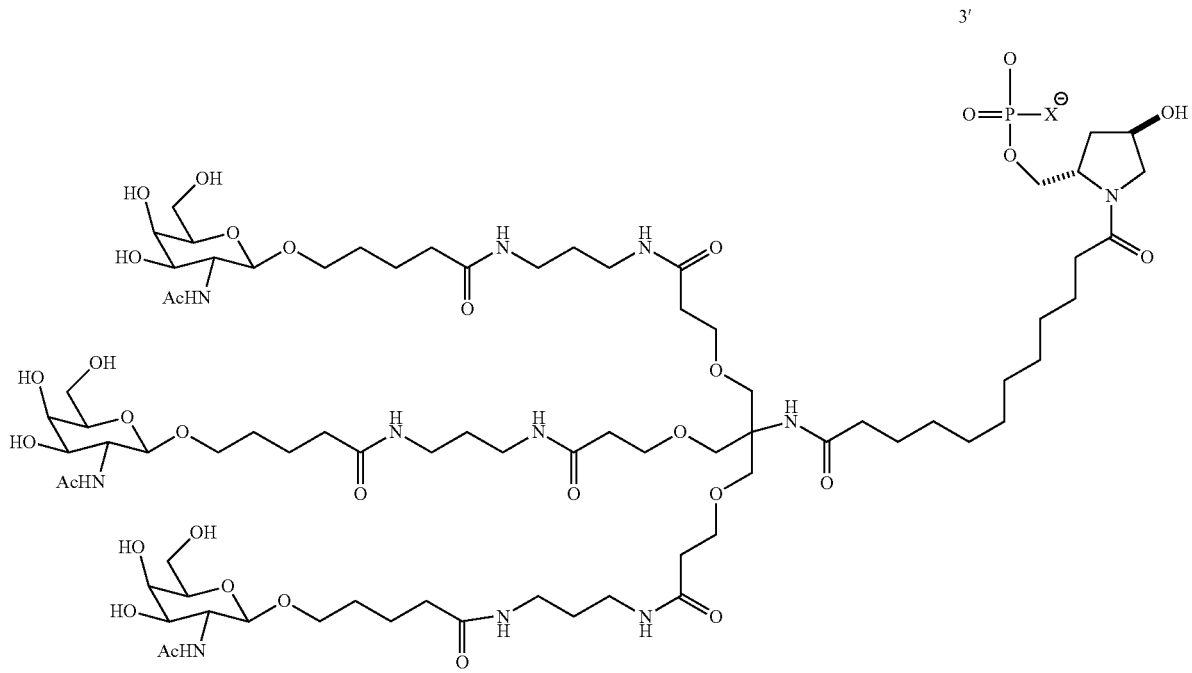

and, wherein X is O or S.

In one embodiment, the X is O.

In one embodiment, the region of complementarity comprises any one of the antisense sequences in any one of Tables 2, 3, 7, 8, 10, 11, or 13.

In one aspect, the present invention provides a double stranded for inhibiting expression of 17β-hydroxysteroid dehydrogenases type 13 (HSD17B13) in a cell. The dsRNA agent includes a sense strand complementary to an antisense strand, wherein the antisense strand comprises a region complementary to part of an mRNA encoding HSD17B13, wherein each strand is about 14 to about 30 nucleotides in length, wherein said dsRNA agent is represented by formula (III):

sense: 5' $n_p$-$N_a$-(X X X)$_i$-$N_b$-Y Y Y-$N_b$-(Z Z Z)$_j$-$N_a$-$n_q$ 3' antisense: 3' $n_p'$-$N_a'$-(X'X'X')$_k$-$N_b'$-Y'Y'Y'-$N_b'$-(Z'Z'Z')$_l$-$N_a'$-$n_q'$ 5'  (III)

wherein:
i, j, k, and l are each independently 0 or 1;
p, p', q, and q' are each independently 0-6;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
each $n_p$, $n_p'$, $n_q$, and $n_q'$, each of which may or may not be present, independently represents an overhang nucleotide;
XXX, YYY, ZZZ, X'X'X', Y'Y'Y', and Z'Z'Z' each independently represent one motif of three identical modifications on three consecutive nucleotides;
modifications on $N_b$ differ from the modification on Y and modifications on $N_b'$ differ from the modification on Y';
and
wherein the sense strand is conjugated to at least one ligand.

In one embodiment, i is 0; j is 0; i is 1; j is 1; both i and j are 0; or both i and j are 1. In another embodiment, k is 0; 1 is 0; k is 1; 1 is 1; both k and 1 are 0; or both k and 1 are 1.

In one embodiment, XXX is complementary to X'X'X', YYY is complementary to Y'Y'Y', and ZZZ is complementary to Z'Z'Z'.

In one embodiment, the YYY motif occurs at or near the cleavage site of the sense strand, e.g., the Y'Y'Y' motif occurs at the 11, 12 and 13 positions of the antisense strand from the 5'-end.

In one embodiment, formula (III) is represented by formula (IIIa):

sense: 5' $n_p$-$N_a$-Y Y Y-$N_a$-$n_q$ 3' antisense: 3' $n_p'$-$N_a'$-Y'Y'Y'-$N_a'$-$n_q'$ 5'  (IIIa).

In another embodiment, formula (III) is represented by formula (IIIb):

sense: 5' $n_p$-$N_a$-Y Y Y-$N_b$-Z Z Z-$N_a$-$n_q$ 3' antisense: 3' $n_p'$-$N_a'$- Y'Y'Y'-$N_b'$-Z'Z'Z'-$N_a'$-$n_q'$ 5'  (IIIb)

wherein each $N_b$ and $N_b'$ independently represents an oligonucleotide sequence comprising 1-5 modified nucleotides.

In yet another embodiment, formula (III) is represented by formula (IIIc):

sense: 5'$n_p$-$N_a$-X X X-$N_b$-Y Y Y-$N_a$-$n_q$ 3' antisense: 3' $n_p'$-$N_a'$-X'X'X'-$N_b'$-Y'Y'Y'-$N_a'$-$n_q'$ 5'  (IIIc)

wherein each $N_b$ and $N_b'$ independently represents an oligonucleotide sequence comprising 1-5 modified nucleotides.

In another embodiment, formula (III) is represented by formula (IIId):

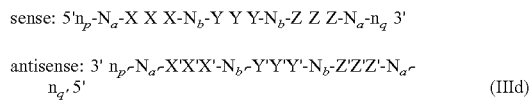

sense: 5'$n_p$-$N_a$-X X X-$N_b$-Y Y Y-$N_b$-Z Z Z-$N_a$-$n_q$ 3' antisense: 3' $n_{p'}$-$N_{a'}$-X'X'X'-$N_{b'}$-Y'Y'Y'-$N_{b'}$-Z'Z'Z'-$N_{a'}$-$n_{q'}$ 5'    (IIId)

wherein each $N_b$ and $N_b'$ independently represents an oligonucleotide sequence comprising 1-5 modified nucleotides and each $N_a$ and $N_a'$ independently represents an oligonucleotide sequence comprising 2-10 modified nucleotides.

The region of complementarity may be at least 17 nucleotides in length; 19 to 30 nucleotides in length; 19-25 nucleotides in length; or 21 to 23 nucleotides in length.

Each strand may be no more than 30 nucleotides in length, e.g., each strand is independently 19-30 nucleotides in length.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-O-methyl, 2'-deoxy, 2'-hydroxyl, and combinations thereof.

In one embodiment, the modifications on the nucleotides are 2'-O-methyl or 2'-fluoro modifications.

In one embodiment, the Y' is a 2'-O-methyl or 2'-fluoro modified nucleotide.

In one embodiment, at least one strand of the dsRNA agent may comprise a 3' overhang of at least 1 nucleotide; or a 3' overhang of at least 2 nucleotides.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand. In one embodiment, the strand is the antisense strand. In another embodiment, the strand is the sense strand.

In one embodiment, the phosphorothioate or methylphosphonate internucleotide linkage is at the 5'-terminus of one strand. In one embodiment, the strand is the antisense strand. In another embodiment, the strand is the sense strand.

In one embodiment, the strand is the antisense strand. In another embodiment, the strand is the sense strand.

In one embodiment, the phosphorothioate or methylphosphonate internucleotide linkage is at both the 5'- and 3'-terminus of one strand.

In one embodiment, the base pair at the 1 position of the 5'-end of the antisense strand of the duplex is an AU base pair.

In one embodiment, p'>0. In another embodiment, p'=2.

In one embodiment, q'=0, p=0, q=0, and p' overhang nucleotides are complementary to the target mRNA. In another embodiment, q'=0, p=0, q=0, and p' overhang nucleotides are non-complementary to the target mRNA.

In one embodiment, the sense strand has a total of 21 nucleotides and the antisense strand has a total of 23 nucleotides.

In one embodiment, at least one $n_p'$ is linked to a neighboring nucleotide via a phosphorothioate linkage. In another embodiment, wherein all $n_p'$ are linked to neighboring nucleotides via phosphorothioate linkages.

In one embodiment, all of the nucleotides of the sense strand and all of the nucleotides of the antisense strand comprise a modification.

In one embodiment, the ligand is conjugated to the 3' end of the sense strand of the dsRNA agent.

In one embodiment, the ligand is one or more N-acetylgalactosamine (GalNAc) derivatives attached through a monovalent, bivalent, or trivalent branched linker.

In one embodiment, the ligand is

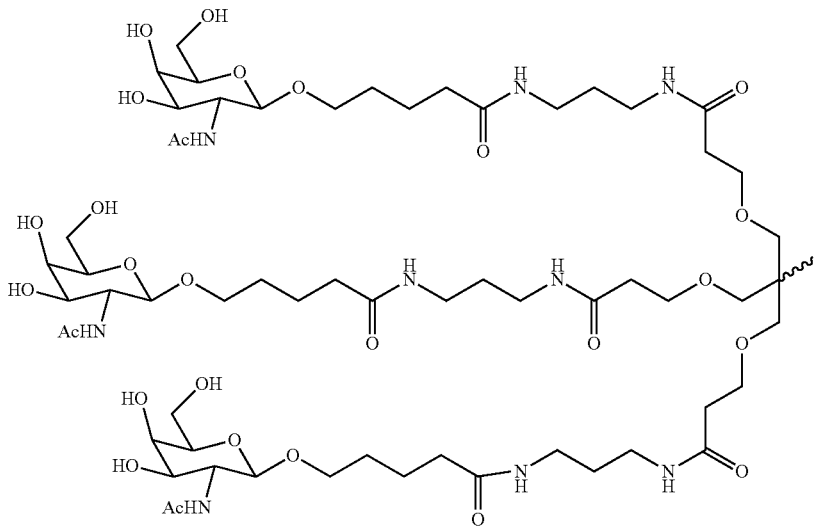

In one embodiment, the dsRNA agent is conjugated to the ligand as shown in the following schematic

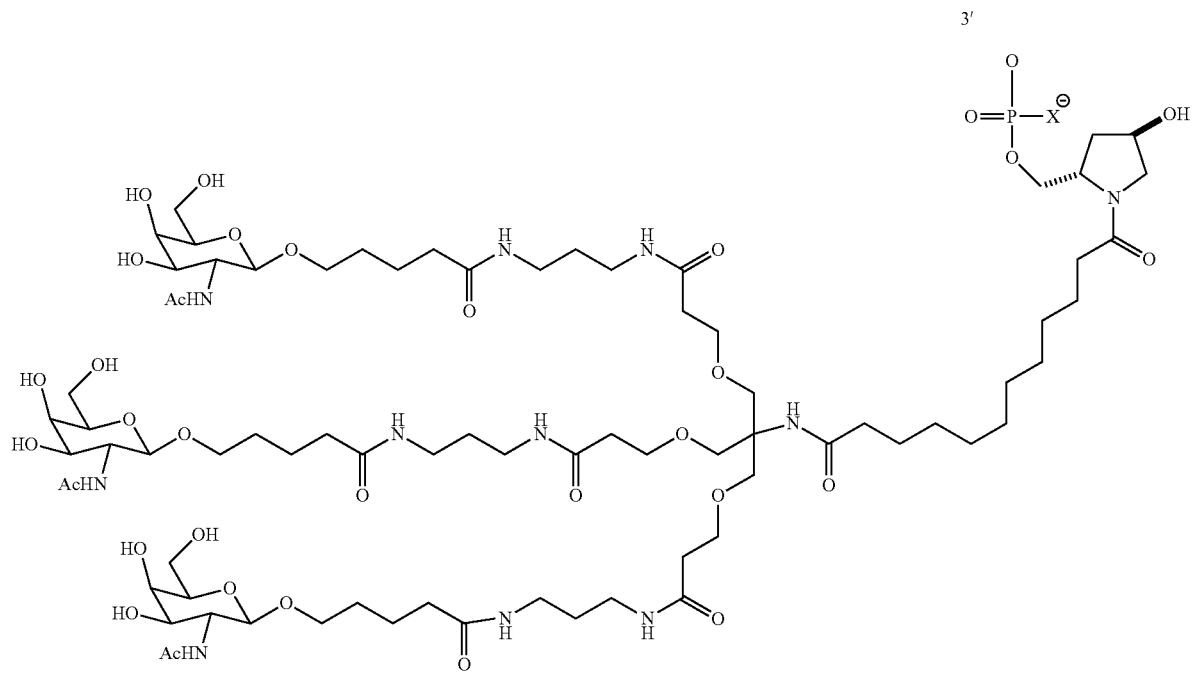

and, wherein X is O or S.

In one embodiment, the X is O.

In one aspect, the present invention provides a double stranded ribonucleic acid (dsRNA) agent for inhibiting the expression of 17β-hydroxysteroid dehydrogenases type 13 (HSD17B13) in a cell. The dsRNA agent includes a sense strand complementary to an antisense strand, wherein the antisense strand comprises a region complementary to part of an mRNA encoding HSD17B13, wherein each strand is about 14 to about 30 nucleotides in length, wherein the dsRNA agent is represented by formula (III):

sense: 5' $n_p$-$N_a$-(X X X)$_i$-$N_b$-Y Y Y-$N_b$-(Z Z Z)$_j$-$N_a$-$n_q$ 3' antisense: 3' $n_p$'-$N_a$'-(X'X'X')$_k$-$N_b$'-Y'Y'Y'-$N_b$'-(Z'Z'Z')$_l$-$N_a$'-$n_q$' 5'  (III)

wherein:

i, j, k, and l are each independently 0 or 1;

p, p', q, and q' are each independently 0-6;

each $N_a$ and $N_a$' independently represents an oligonucleotide sequence comprising 0-25 nucleotides which are either modified or unmodified or combinations thereof, each sequence comprising at least two differently modified nucleotides;

each $N_b$ and $N_b$' independently represents an oligonucleotide sequence comprising 0-10 nucleotides which are either modified or unmodified or combinations thereof;

each $n_p$, $n_p$', $n_q$, and $n_q$', each of which may or may not be present independently represents an overhang nucleotide;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b$' differ from the modification on Y'; and wherein the sense strand is conjugated to at least one ligand.

In one aspect, the present invention provides a double stranded ribonucleic acid (dsRNA) agent for inhibiting the expression of 17β-hydroxysteroid dehydrogenases type 13 (HSD17B13) in a cell. The dsRNA agent includes a sense strand complementary to an antisense strand, wherein the antisense strand comprises a region complementary to part of an mRNA encoding HSD17B13, wherein each strand is about 14 to about 30 nucleotides in length, wherein the dsRNA agent is represented by formula (III):

sense: 5' $n_p$-$N_a$-(X X X)$_i$-$N_b$-Y Y Y-$N_b$-(Z Z Z)$_j$-$N_a$-$n_q$ 3' antisense: 3' $n_p$'-$N_a$'-(X'X'X')$_k$-$N_b$'-Y'Y'Y'-$N_b$'-(Z'Z'Z')$_l$-$N_a$'-$n_q$' 5'  (III)

wherein:

i, j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence comprising 0-25 nucleotides which are either modified or unmodified or combinations thereof, each sequence comprising at least two differently modified nucleotides;

each $N_b$ and $N_b$' independently represents an oligonucleotide sequence comprising 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b$' differ from the modification on Y'; and wherein the sense strand is conjugated to at least one ligand.

In one aspect, the present invention provides a double stranded ribonucleic acid (dsRNA) agent for inhibiting the expression of 17β-hydroxysteroid dehydrogenases type 13 (HSD17B13) in a cell. The dsRNA agent includes a sense strand complementary to an antisense strand, wherein the antisense strand comprises a region complementary to part of an mRNA encoding HSD17B13, wherein each strand is about 14 to about 30 nucleotides in length, wherein the dsRNA agent is represented by formula (III):

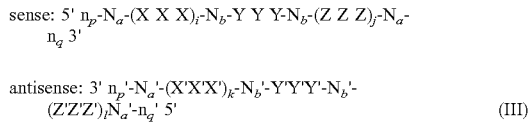

(III)

wherein:
i, j, k, and l are each independently 0 or 1;
each $n_p$, $n_q$, and $n_q'$, each of which may or may not be present, independently represents an overhang nucleotide;
p, q, and q' are each independently 0-6;
$n_p'>0$ and at least one $n_p'$ is linked to a neighboring nucleotide via a phosphorothioate linkage;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;
modifications on $N_b$ differ from the modification on Y and modifications on $N_b'$ differ from the modification on Y'; and
wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of 17β-hydroxysteroid dehydrogenases type 13 (HSD17B13) in a cell. The dsRNA agent includes a sense strand complementary to an antisense strand, wherein the antisense strand comprises a region complementary to part of an mRNA encoding HSD17B13, wherein each strand is about 14 to about 30 nucleotides in length, wherein the dsRNA agent is represented by formula (III):

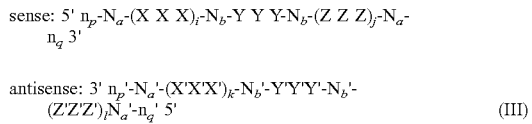

(III)

wherein:
i, j, k, and l are each independently 0 or 1;
each $n_p$, $n_q$, and $n_q'$, each of which may or may not be present, independently represents an overhang nucleotide;
p, q, and q' are each independently 0-6;
$n_p'>0$ and at least one $n_p'$ is linked to a neighboring nucleotide via a phosphorothioate linkage;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;
modifications on $N_b$ differ from the modification on Y and modifications on $N_b'$ differ from the modification on Y';
wherein the sense strand comprises at least one phosphorothioate linkage; and
wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of 17β-hydroxysteroid dehydrogenases type 13 (HSD17B13) in a cell. The dsRNA agent includes a sense strand complementary to an antisense strand, wherein the antisense strand comprises a region complementary to part of an mRNA encoding HSD17B13, wherein each strand is about 14 to about 30 nucleotides in length, wherein the dsRNA agent is represented by formula (III):

sense: 5' $n_p$-$N_a$-Y Y Y-$N_a$-$n_q$ 3'

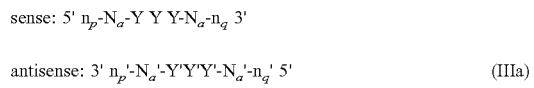

(IIIa)

wherein:
each $n_p$, $n_q$, and $n_q'$, each of which may or may not be present, independently represents an overhang nucleotide;
p, q, and q' are each independently 0-6;
$n_p'>0$ and at least one $n_p'$ is linked to a neighboring nucleotide via a phosphorothioate linkage;
each $N_a$ and $N_a'$ independently represents an oligonucleotide sequence comprising 0-25 nucleotides which are either modified or unmodified or combinations thereof, each sequence comprising at least two differently modified nucleotides;
YYY and Y'Y'Y' each independently represent one motif of three identical modifications on three consecutive nucleotides, and wherein the modifications are 2'-O-methyl and/or 2'-fluoro modifications;
wherein the sense strand comprises at least one phosphorothioate linkage; and
wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of 17β-hydroxysteroid dehydrogenases type 13 (HSD17B13) in a cell. The dsRNA agent includes a sense strand and an antisense strand forming a double stranded region, wherein the sense strand comprises at least 15 contiguous nucleotides differing by no more than 1, 2, or 3 nucleotides from the nucleotide sequence of SEQ ID NO:1 or 2 and the antisense strand comprises at least 15 contiguous nucleotides differing by no more than 1, 2, or 3 nucleotides from the nucleotide sequence of SEQ ID NO:8 or 9, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a monovalent, bivalent or trivalent branched linker at the 3'-terminus. In some embodiments, the dsRNA agent includes a sense strand and an antisense strand forming a double stranded region, wherein the sense strand comprises at least 15 contiguous nucleotides from the nucleotide sequence of SEQ ID NO:1 or 2 and the antisense strand comprises at least 15 contiguous nucleotides from the nucleotide sequence of SEQ ID NO:8 or 9, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a monovalent, bivalent or trivalent branched linker at the 3'-terminus.

In one embodiment, all of the nucleotides of the sense strand and all of the nucleotides of the antisense strand are modified nucleotides.

In one embodiment, the region of complementarity comprises any one of the antisense sequences listed in any one of Tables 2, 3, 7, 8, 10, 11, or 13. In one embodiment, the agent is selected from the group consisting of AD-288917, AD-288996, AD-413639, AD-413644, and AD-413669. In one embodiment, the RNAi agent is AD-288917. In another embodiment, the agent is AD-288996. In another embodiment, the agent is AD-413639. In one embodiment, the agent is AD-413644. In another embodiment, the agent is AD-413669

In one embodiment, the sense strand and the antisense strand comprise nucleotide sequences selected from the group consisting of the nucleotide sequences of any one of the agents listed in any one of Tables 2, 3, 7, 8, 10, 11, or 13.

The present invention also provides cells, vectors, and pharmaceutical compositions which include any of the dsRNA agents of the invention. The dsRNA agents mat be formulated in an unbuffered solution, e.g., saline or water, or in a buffered solution, e.g., a solution comprising acetate, citrate, prolamine, carbonate, or phosphate or any combination thereof. In one embodiment, the buffered solution is phosphate buffered saline (PBS).

In one aspect, the present invention provides a method of inhibiting 17β-hydroxysteroid dehydrogenases type 13 (HSD17B13) expression in a cell. The method includes contacting the cell with a dsRNA agent or a pharmaceutical composition of the invention, thereby inhibiting expression of HSD17B13 in the cell.

The cell may be within a subject, such as a human subject.

In one embodiment, the HSD17B13 expression is inhibited by at least 30%, 40%, 50%, 60%, 70%, 80%, 90%, 95%, or to below the level of detection of HSD17B13 expression.

In one embodiment, the human subject suffers from an HSD17B13-associated disease, disorder, or condition. In one embodiment, the HSD17B13-associated disease, disorder, or condition is a chronic fibro-inflammatory liver disease. In one embodiment, the chronic fibro-inflammatory liver disease is selected from the group consisting of inflammation of the liver, liver fibrosis, nonalcoholic steatohepatitis (NASH), nonalcoholic fatty liver disease (NAFLD), cirrhosis of the liver, alcoholic steatohepatitis (ASH), alcoholic liver diseases (ALD), HCV-associated cirrhosis, drug induced liver injury, and hepatocellular necrosis.

In one aspect, the present invention provides a method of inhibiting the expression of HSD17B13 in a subject. The methods include administering to the subject a therapeutically effective amount of a dsRNA agent or a pharmaceutical composition of the invention, thereby inhibiting the expression of HSD17B13 in the subject.

In another aspect, the present invention provides a method of treating a subject suffering from an HSD17B13-associated disease, disorder, or condition. The method includes administering to the subject a therapeutically effective amount of of a dsRNA agent or a pharmaceutical composition of the invention, thereby treating the subject suffering from an HSD17B13-associated disease, disorder, or condition.

In another aspect, the present invention provides a method of preventing at least one symptom in a subject having a disease, disorder or condition that would benefit from reduction in expression of an HSD17B13 gene. The method includes administering to the subject a prophylactically effective amount of the agent of a dsRNA agent or a pharmaceutical composition of the invention, thereby preventing at least one symptom in a subject having a disease, disorder or condition that would benefit from reduction in expression of an HSD17B13 gene.

In another aspect, the present invention provides a method of reducing the risk of developing chronic liver disease in a subject having steatosis. The method includes administering to the subject a therapeutically effective amount of a dsRNA agent or a pharmaceutical composition of the invention, thereby reducing the risk of developing chronic liver disease in the subject having steatosis.

In yet another aspect, the present invention provides a method of inhibiting the progression of steatosis to steatohepatitis in a subject suffering from steatosis. The method includes administering to the subject a therapeutically effective amount of a dsRNA agent or a pharmaceutical composition of the invention, thereby inhibiting the progression of steatosis to steatohepatitis in the subject.

In one aspect, the present invention provides a method of inhibiting the accumulation of lipid droplets in the liver of a subject suffering from an HSD17B13-associated disease, disorder, or condition. The method includes administering to the subject a therapeutically effective amount of a dsRNA agent or a pharmaceutical composition of the invention, and a dsRNA agent targeting a PNPLA3 gene or a pharmaceutical composition comprising a dsRNA agent targeting a PNPLA3 gene, thereby inhibiting the accumulation of fat in the liver of the subject suffering from an HSD17B13-associated disease, disorder, or condition.

In another aspect, the present invention provides a method of treating a subject suffering from an HSD17B13-associated disease, disorder, or condition. The method includes administering to the subject a therapeutically effective amount of a dsRNA agent or a pharmaceutical composition of the invention, and a dsRNA agent targeting a PNPLA3 gene or a pharmaceutical composition comprising a dsRNA agent targeting a PNPLA3 gene, thereby treating the subject suffering from an HSD17B13-associated disease, disorder, or condition.

In another aspect, the present invention provides a method of preventing at least one symptom in a subject having a disease, disorder or condition that would benefit from reduction in expression of an HSD17B13 gene. The method includes administering to the subject a therapeutically effective amount of a dsRNA agent or a pharmaceutical composition of the invention, and a dsRNA agent targeting a PNPLA3 gene or a pharmaceutical composition comprising a dsRNA agent targeting a PNPLA3 gene, thereby preventing at least one symptom in a subject having a disease, disorder or condition that would benefit from reduction in expression of an HSD17B13 gene.

In another aspect, the present invention provides a method of reducing the risk of developing chronic liver disease in a subject having steatosis. The method includes administering to the subject a therapeutically effective amount of a dsRNA agent or a pharmaceutical composition of the invention, and a dsRNA agent targeting a PNPLA3 gene or a pharmaceutical composition comprising a dsRNA agent targeting a PNPLA3 gene, thereby reducing the risk of developing chronic liver disease in the subject having steatosis.

In another aspect, the present invention provides a method of inhibiting the progression of steatosis to steatohepatitis in a subject suffering from steatosis. The method includes administering to the subject a therapeutically effective amount of a dsRNA agent or a pharmaceutical composition of the invention, and a dsRNA agent targeting a PNPLA3 gene or a pharmaceutical composition comprising a dsRNA agent targeting a PNPLA3 gene, thereby inhibiting the progression of steatosis to steatohepatitis in the subject.

In one embodiment, the administration of the dsRNA agent or the pharmaceutical composition to the subject causes a decrease in HSD17B13 enzymatic activity, a decrease in HSD17B13 protein accumulation, a decrease in PNPLA3 enzymatic activity, a decrease in PNPLA3 protein accumulation, and/or a decrease in accumulation of fat and/or expansion of lipid droplets in the liver of a subject.

In one embodiment, the HSD17B13-associated disease, disorder, or condition is a chronic fibro-inflammatory liver disease.

In one embodiment, the chronic fibro-inflammatory liver disease is selected from the group consisting of accumulation of fat in the liver, inflammation of the liver, liver fibrosis, nonalcoholic steatohepatitis (NASH), nonalcoholic fatty liver disease (NAFLD), cirrhosis of the liver, alcoholic steatohepatitis (ASH), alcoholic liver diseases (ALD), HCV-associated cirrhosis, drug induced liver injury, and hepatocellular necrosis.

In one embodiment, the chronic fibro-inflammatory liver disease is nonalcoholic steatohepatitis (NASH).

In one embodiment, the subject is obese.

In one embodiment, the methods and uses of the invention further include administering an additional therapeutic to the subject.

In one embodiment, the dsRNA agent is administered to the subject at a dose of about 0.01 mg/kg to about 10 mg/kg or about 0.5 mg/kg to about 50 mg/kg.

The agent may be administered to the subject intravenously, intramuscularly, or subcutaneously. In one embodiment, the agent is administered to the subject subcutaneously.

In one embodiment, the methods and uses of the invention further include determining the level of HSD17B13 in the subject.

In one aspect, the present invention provides a double stranded ribonucleic acid (dsRNA) agent for inhibiting expression of 17β-hydroxysteroid dehydrogenases type 13 (HSD17B13) in a cell, wherein the dsRNA agent comprises a sense strand and an antisense strand forming a double stranded region, wherein the sense strand comprises a nucleotide sequence of any one of the agents in any one of Tables 2, 3, 7, 8, 10, 11, or 13, and the antisense strand comprises a nucleotide sequence of any one of the agents in any one of Tables 2, 3, 7, 8, 10, 11, or 13, wherein substantially all of the nucleotide of the sense strand and substantially all of the nucleotides of the antisense strand are modified nucleotides, and wherein the dsRNA agent is conjugated to a ligand.

BRIEF DESCRIPTION OF THE DRAWINGS

FIG. 1 shows HSD17B13 rs72613567:TA was associated with lower odds of various chronic liver diseases in an allele dosage-dependent manner. Specifically, allele dosage-dependent effects were observed for both alcoholic and non-alcoholic liver diseases, cirrhosis and hepatocellular carcinoma. Odds ratios were calculated using logistic regression, with adjustment for age, gender, BMI, and self-reported ethnicity.

DETAILED DESCRIPTION OF THE INVENTION

Figure 1:
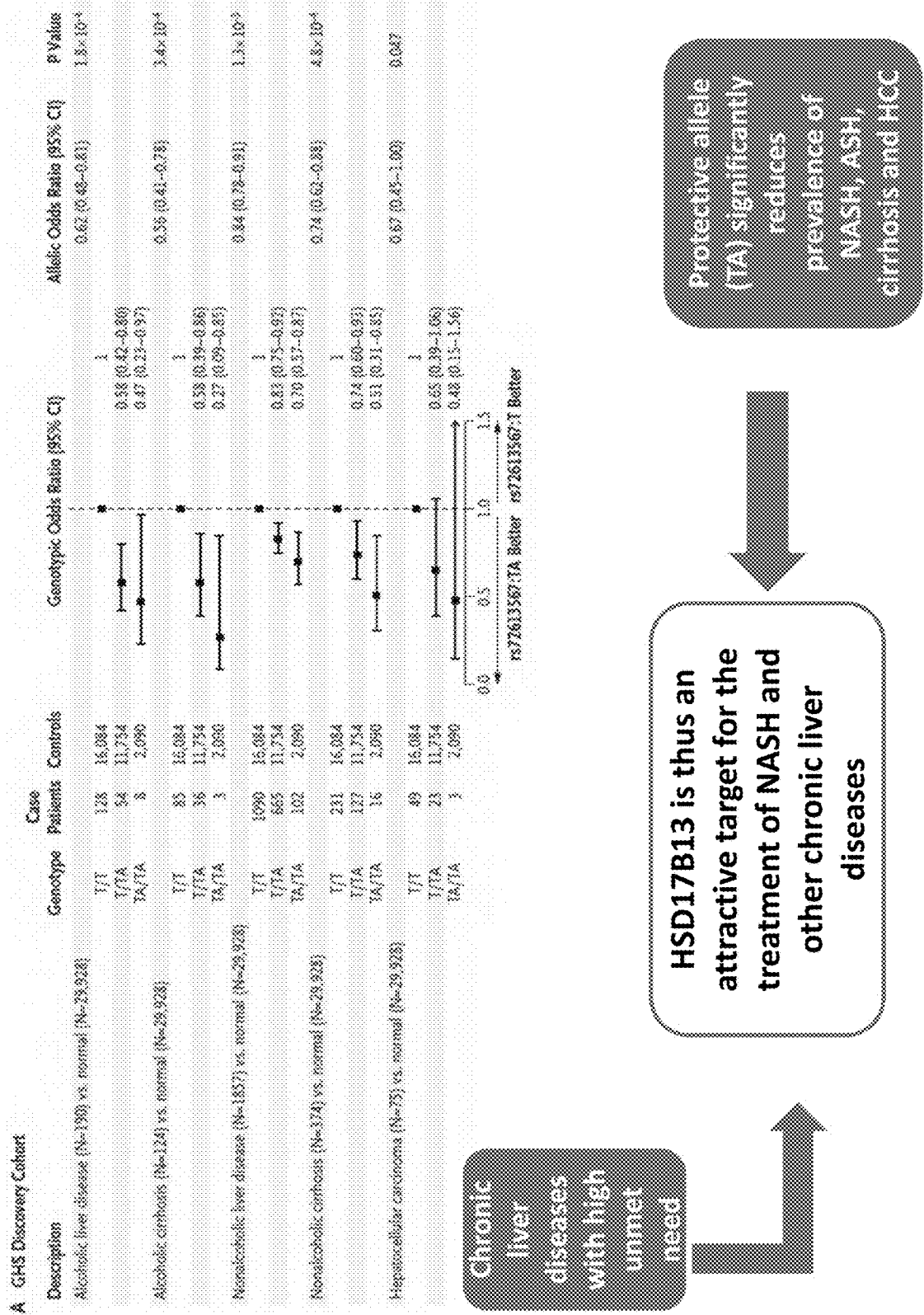
FIG. 1 shows that HSD17B13 rs72613567:TA is associated with reduced risk of alcoholic and nonalcoholic liver disease phenotypes. Specifically.

The present invention provides iRNA compositions, which effect the RNA-induced silencing complex (RISC)-mediated cleavage of RNA transcripts of an HSD17B13 gene. The HSD17B13 gene may be within a cell, e.g., a cell within a subject, such as a human. The present invention also provides methods of using the iRNA compositions of the invention for inhibiting the expression of an HSD17B13 gene, and for treating a subject who would benefit from inhibiting or reducing the expression of an HSD17B13 gene, e.g., a subject that would benefit from a reduction in inflammation of the liver, e.g., a subject suffering or prone to suffering from an HSD17B13-associated disease disorder, or condition, such as a subject suffering or prone to suffering from liver fibrosis, nonalcoholic steatohepatitis (NASH), nonalcoholic fatty liver disease (NAFLD), alcoholic steatohepatitis (ASH), alcoholic liver diseases (ALD), cirrhosis of the liver, HCV-associated cirrhosis, drug induced liver injury, and hepatocellular necrosis.

The iRNAs of the invention targeting HSD17B13 may include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an HSD17B13 gene.

In some embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of an HSD17B13 gene. In some embodiments, such iRNA agents having longer length antisense strands may include a second RNA strand (the sense strand) of 20-60 nucleotides in length wherein the sense and antisense strands form a duplex of 18-30 contiguous nucleotides.

The use of the iRNA agents described herein enables the targeted degradation of mRNAs of an HSD17B13 gene in mammals.

Very low dosages of the iRNAs, in particular, can specifically and efficiently mediate RNA interference (RNAi), resulting in significant inhibition of expression of an HSD17B13 gene. Thus, methods and compositions including these iRNAs are useful for treating a subject who would benefit from inhibiting or reducing the expression of an HSD17B13 gene, e.g., a subject that would benefit from a reduction of inflammation of the liver, e.g., a subject suffering or prone to suffering from an HSD17B13-associated disease disorder, or condition, such as a subject suffering or prone to suffering from liver fibrosis, nonalcoholic steatohepatitis (NASH), nonalcoholic fatty liver disease (NAFLD), alcoholic steatohepatitis (ASH), alcoholic liver diseases (ALD), cirrhosis of the liver, HCV-associated cirrhosis, drug induced liver injury, and hepatocellular necrosis.

The following detailed description discloses how to make and use compositions containing iRNAs to inhibit the expression of an HSD17B13 gene, as well as compositions and methods for treating subjects having diseases and disorders that would benefit from inhibition and/or reduction of the expression of this gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise.

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "HSD17B13," also known as "hydroxysteroid 17-beta dehydrogenase 13," "short chain dehydrogenase/reductase family 16C member," "short-chain dehydrogenase/reductase 9," "17-beta-HSD 13," "17β-HSD13," "SDR16C3," "SCDR9," "short chain dehydrogenase/reductase family 16C, Member 3," "hydroxysteroid (17-beta) dehydrogenase 13," "17-beta-hydroxysteroid dehydrogenase 13," "17-beta hydroxysteroid dehydrogenase," "HMFN0376," and "NIIL497," refers to the well known gene encoding a 17β-hydroxysteroid dehydrogenase type 13 protein from any vertebrate or mammalian source, including, but not limited to, human, bovine, chicken, rodent, mouse, rat, porcine, ovine, primate, monkey, and guinea pig, unless specified otherwise.

The term also refers to fragments and variants of native HSD17B13 that maintain at least one in vivo or in vitro activity of a native HSD17B13. The term encompasses full-length unprocessed precursor forms of HSD17B13 as well as mature forms resulting from post-translational cleavage of the signal peptide and forms resulting from proteolytic processing.

Two variants of the human HSD17B13 gene were previously identified, variant A (or Transcript A) and variant B (or Transcript B). Transcript A includes all seven exons of the HSD17B13 gene, whereas exon 2 is skipped in Transcript B. The nucleotide and amino acid sequence of a human HSD17B13 variant A can be found in, for example, GenBank Reference Sequence: NM_178135.4; SEQ ID NO:1); and the nucleotide and amino acid sequence of a human HSD17B13 variant B can be found in, for example, GenBank Reference Sequence: NM_001136230.2; SEQ ID NO:2. As described in U.S. patent application Ser. No. 15/875,514, filed on Jan. 19, 2018, and PCT Application No.: PCT/US2018/014357, filed on Jan. 19, 2018 (the entire contents of each of which are incorporated herein by reference), six additional HSD17B13 transcripts that are expressed (C-H, SEQ ID NOS: 17, 18, 19, 20, 21, and 22, respectively) have been identified. In Transcript C, exon 6 is skipped compared to Transcript A. In Transcript D, there is an insertion of a guanine 3' of exon 6, resulting in a frameshift in and premature truncation of exon 7 compared to Transcript A. In Transcript E, there is an additional exon between exons 3 and 4 compared to Transcript A. In Transcript F, which is expressed only in HSD17B13 rs72613567 variant carriers, there is read-through from exon 6 into intron 6 compared to Transcript A. In Transcript G, exon 2 is skipped, and there is an insertion of a guanine 3' of exon 6, resulting in a frameshift in and premature truncation of exon 7 compared to Transcript A. In Transcript H, there is an additional exon between exons 3 and 4, and there is an insertion of a guanine 3' of exon 6, resulting in a frameshift in and premature truncation of exon 7 compared to Transcript A.

One additional HSD17B13 transcript that is expressed at low levels (F', SEQ ID NO: 23) has also been identified. Like Transcript F, Transcript F' also includes a read-through from exon 6 into intron 6 compared to Transcript A, but, in contrast to Transcript F, the read-through does not include the inserted thymine present in the HSD17B13 rs72613567 variant gene. The nucleotide positions of the exons within the HSD17B13 genes for each Transcript are provided below.

SEQ ID NO: 15 is the nucleotide sequence of the HSD17B13 Wild Type Genomic Sequence (Human Genome Assembly GRCh38) and SEQ ID NO: 16 is the nucleotide sequence of HSD17B13 Genomic Sequence Variant (Human Genome Assembly GRCh38; rs72613567-insertion of T at chr4: 87310241-87310240): Insertion of T at position 12666.

Nucleotide Positions in SEQ ID NO: 15 for Exons of HSD17B13 Transcripts More Prevalent in Subjects Homozygous for Wild Type HSD17B13 Gene.

|        | Transcript A | Transcript B | Transcript E | Transcript F' |
|--------|--------------|--------------|--------------|---------------|
| Exon 1 | 1-275        | 1-275        | 1-275        | 1-275         |
| Exon 2 | 4471-4578    | skipped      | 4471-4578    | 4471-4578     |
| Exon 3 | 5684-5815    | 5684-5815    | 5684-5815    | 5684-5815     |
| Exon 3'| not present  | not present  | 6210-6281    | not present   |
| Exon 4 | 7308-7414    | 7308-7414    | 7308-7414    | 7308-7414     |
| Exon 5 | 8947-9084    | 8947-9084    | 8947-9084    | 8947-9084     |
| Exon 6 | 12548-12664  | 12548-12664  | 12548-12664  | 12548-13501*  |
| Exon 7 | 17599-19118  | 17599-19118  | 17599-19118  | skipped       |

*Includes read-through from exon 6 into intron 6; read-through = positions 12665-13501

Nucleotide Positions in SEQ ID NO: 16 for Exons of HSD17B13 Transcripts More Prevalent in Subjects Homozygous for Rs72613567 HSD17B13 Variant Gene (Insertion of T at Position 12666).

|        | Transcript C | Transcript D | Transcript F | Transcript G | Transcript H |
|--------|--------------|--------------|--------------|--------------|--------------|
| Exon 1 | 1-275        | 1-275        | 1-275        | 1-275        | 1-275        |
| Exon 2 | 4471-4578    | 4471-4578    | 4471-4578    | skipped      | 4471-4578    |
| Exon 3 | 5684-5815    | 5684-5815    | 5684-5815    | 5684-5815    | 5684-5815    |
| Exon 3'| not present  | not present  | not present  | not present  | 6210-6281    |
| Exon 4 | 7308-7414    | 7308-7414    | 7308-7414    | 7308-7414    | 7308-7414    |
| Exon 5 | 8947-9084    | 8947-9084    | 8947-9084    | 8947-9084    | 8947-9084    |
| Exon 6 | skipped      | 12548-12665^ | 12548-13502* | 12548-12665^ | 12548-12665^ |
| Exon 7 | 17600-19119  | 17600-19119  | skipped      | 17600-19119  | 17600-19119  |

^Includes additional residue 12665 at 3' end compared to Transcript A
*Includes read-through from exon 6 into intron 6; read-through = positions 12665-13502

There are two variants of the mouse HSD17B13 gene; the nucleotide and amino acid sequence of a mouse Hsd17b13, transcript variant 1 can be found in, for example, GenBank Reference Sequence: NM_001163486.1; SEQ ID NO:3); and the nucleotide and amino acid sequence of a mouse Hsd17b13, transcript variant 2 can be found in, for example, GenBank Reference Sequence: NM_198030.2; SEQ ID NO:4. The nucleotide and amino acid sequence of a rat Hsd17b13 gene can be found in, for example, GenBank Reference Sequence: NM_001009684.1; SEQ ID NO:5). The nucleotide and amino acid sequence of a *Macaca mulatta* HSD17B13 gene can be found in, for example, GenBank Reference Sequence: XM_015138766.1; SEQ ID NO:6). The nucleotide and amino acid sequence of a *Macaca fascicularis* HSD17B13 gene can be found in, for example, GenBank Reference Sequence: XM_005555367.2; SEQ ID NO:7).

Additional examples of HSD17B13 mRNA sequences are readily available using publicly available databases, e.g., GenBank, UniProt, and OMIM.

The term "HSD17B13" as used herein also refers to a particular polypeptide expressed in a cell by naturally occurring DNA sequence variations of the HSD17B13 gene, such as a single nucleotide polymorphism in the HSD17B13 gene. Numerous SNPs within the HSD17B13 gene have been identified and may be found at, for example, NCBI dbSNP (see, e.g., www.ncbi.nlm.nih.gov/snp).

As used herein, "target sequence" refers to a contiguous portion of the nucleotide sequence of an mRNA molecule formed during the transcription of a HSD17B13 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a HSD17B13 gene.

The target sequence of an HSD17B13 gene may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of HSD17B13 gene in a cell, e.g., a cell within a subject, such as a mammalian subject.

In one embodiment, an RNAi agent of the invention includes a single stranded RNA that interacts with a target RNA sequence, e.g., an HSD17B13 target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (sssiRNA) generated within a cell and which promotes the formation of a RISC complex to effect silencing of the target gene, i.e., an HSD17B13 gene. Accordingly, the term "siRNA" is also used herein to refer to an RNAi as described above.

In another embodiment, the RNAi agent may be a single-stranded RNAi agent that is introduced into a cell or organism to inhibit a target mRNA. Single-stranded RNAi agents (ssRNAi) bind to the RISC endonuclease, Argonaute 2, which then cleaves the target mRNA. The single-stranded siRNAs are generally 15-30 nucleotides and are chemically modified. The design and testing of single-stranded RNAi agents are described in U.S. Pat. No. 8,101,348 and in Lima et al., (2012) *Cell* 150: 883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150; 883-894.

In another embodiment, an "iRNA" for use in the compositions and methods of the invention is a double-stranded RNA and is referred to herein as a "double stranded RNAi agent," "double-stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., an HSD17B13 gene. In some embodiments of the invention, a double-stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, and/or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA, each strand of which comprises less than 30 nucleotides, e.g., 17-27, 19-27, 17-25, 19-25, or 19-23, that interacts with a target RNA sequence, e.g., an HSD17B13 target mRNA sequence, to direct the cleavage of the target RNA. In another embodiment, an RNAi agent of the invention is a dsRNA, each strand of which comprises 19-23 nucleotides, that interacts with a target RNA sequence, e.g., an HSD17B13 target mRNA sequence, to direct the cleavage of the target RNA. In one embodiment, the sense strand is 21 nucleotides in length. In another embodiment, the antisense strand is 23 nucleotides in length.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

In certain embodiments, the overhang on the sense strand or the antisense strand, or both, can include extended lengths longer than 10 nucleotides, e.g., 10-30 nucleotides, 10-25 nucleotides, 10-20 nucleotides or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

The term "antisense strand" or "guide strand" refers to the strand of an iRNA, e.g., a dsRNA, which includes a region that is substantially complementary to a target sequence, e.g., an HSD17B13 mRNA.

As used herein, the term "region of complementarity" refers to the region on the antisense strand that is substantially complementary to a sequence, for example a target sequence, e.g., an HSD17B13 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- and/or 3'-terminus of the iRNA.

The term "sense strand" or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding HSD17B13). For example, a polynucleotide is complementary to at least a part of an HSD17B13 mRNA if the sequence is substantially complementary to a non-interrupted portion of an mRNA encoding HSD17B13.

Accordingly, in some embodiments, the antisense strand polynucleotides disclosed herein are fully complementary to the target HSD17B13 sequence. In other embodiments, the antisense strand polynucleotides disclosed herein are substantially complementary to the target HSD17B13 sequence and comprise a contiguous nucleotide sequence which is at least about 80% complementary over its entire length to the equivalent region of the nucleotide sequence of SEQ ID NO:1, or a fragment of SEQ ID NO:1, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target HSD17B13 sequence, and wherein the sense strand polynucleotide comprises a contiguous nucleotide sequence which is at least about 80% complementary over its entire length to the equivalent region of the nucleotide sequence of SEQ ID NO:8, or a fragment of any one of SEQ ID NO:8, such as about 85%, about 86%, about 87%, about 88%, about 89%, about 90%, about % 91%, about 92%, about 93%, about 94%, about 95%, about 96%, about 97%, about 98%, or about 99% complementary.

In some embodiments, an iRNA of the invention includes an antisense strand that is substantially complementary to the target HSD17B13 sequence and comprises a contiguous nucleotide sequence which is at least about 80% complementary over its entire length to the equivalent region of the nucleotide sequence of any one of the sense strands in any one of Tables 2, 3, 7, 8, 10, 11, or 13, or a fragment of any one of the sense strands in any one of Tables 2, 3, 7, 8, 10, 11, or 13, such as about about 85%, 86%, 87%, 88%, 89%, 90%, 91%, 92%, 93%, 94%, 95%, 96%, 97%, 98%, or 99% complementary, or 100% complementary.

The term "inhibiting," as used herein, is used interchangeably with "reducing," "silencing," "downregulating," "suppressing" and other similar terms, and includes any level of inhibition.

The phrase "inhibiting expression of an HSD17B13 gene," as used herein, includes inhibition of expression of any HSD17B13 gene (such as, e.g., a mouse HSD17B13 gene, a rat HSD17B13 gene, a monkey HSD17B13 gene, or a human HSD17B13 gene) as well as variants or mutants of an HSD17B13 gene that encode an HSD17B13 protein.

"Inhibiting expression of an HSD17B13 gene" includes any level of inhibition of an HSD17B13 gene, e.g., at least partial suppression of the expression of an HSD17B13 gene, such as an inhibition by at least about 20%. In certain embodiments, inhibition is by at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

The expression of an HSD17B13 gene may be assessed based on the level of any variable associated with HSD17B13 gene expression, e.g., HSD17B13 mRNA level or HSD17B13 protein level. The expression of an HSD17B13 gene may also be assessed indirectly based on, for example, the levels of circulating alanine aminotransferase (ALT), or the enzymatic activity of HSD17B13 in a tissue sample, such as a liver sample. Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In one embodiment, at least partial suppression of the expression of an HSD17B13 gene, is assessed by a reduction of the amount of HSD17B13 mRNA which can be isolated from, or detected, in a first cell or group of cells in which an HSD17B13 gene is transcribed and which has or have been treated such that the expression of an HSD17B13 gene is inhibited, as compared to a second cell or group of cells substantially identical to the first cell or group of cells but which has or have not been so treated (control cells).

The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an RNAi agent," such as a dsRNA, as used herein, includes contacting a cell by any possible means. Contacting a cell with an RNAi agent includes contacting a cell in vitro with the iRNA or contacting a cell in vivo with the iRNA. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the bloodstream or the subcutaneous space, such that the agent will subsequently reach the tissue where the cell to be contacted is located. For example, the RNAi agent may contain and/or be coupled to a ligand, e.g., GalNAc3, that directs the RNAi agent to a site of interest, e.g., the liver. Combinations of in vitro and in vivo methods of contacting are also possible. For example, a cell may also be contacted in vitro with an RNAi agent and subsequently transplanted into a subject.

In one embodiment, contacting a cell with an iRNA includes "introducing" or "delivering the iRNA into the cell" by facilitating or effecting uptake or absorption into the cell. Absorption or uptake of an iRNA can occur through unaided diffusive or active cellular processes, or by auxiliary agents or devices. Introducing an iRNA into a cell may be in vitro and/or in vivo. For example, for in vivo introduction, iRNA can be injected into a tissue site or administered systemically. In vivo delivery can also be done by a beta-glucan delivery system, such as those described in U.S. Pat. Nos. 5,032,401 and 5,607,677, and U.S. Publication No. 2005/0281781, the entire contents of which are hereby incorporated herein by reference. In vitro introduction into a cell includes methods known in the art such as electroporation and lipofection. Further approaches are described herein below and/or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858, 225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose).

In an embodiment, the subject is a human, such as a human being treated or assessed for a disease, disorder or condition that would benefit from reduction in HSD17B13 expression; a human at risk for a disease, disorder or condition that would benefit from reduction in HSD17B13 expression; a human having a disease, disorder or condition that would benefit from reduction in HSD17B13 expression; and/or human being treated for a disease, disorder or condition that would benefit from reduction in HSD17B13 expression as described herein.

In one embodiment, the subject is heterozygous for the gene encoding the patatin like phospholipase domain containing 3 (PNPLA3) I148M variation. In another embodiment, the subject is homozygous for the gene encoding the PNPLA3 I148M variation. In one embodiment, the subject is heterozygous for the gene encoding the patatin like phospholipase domain containing 3 (PNPLA3) I144M variation. In another embodiment, the subject is homozygous for the gene encoding the PNPLA3 I144M variation. In one embodiment, the subject is homozygous for the gene encoding a functional HSD17B13 protein. In another embodiment, the subject is heterozygous for the gene encoding a functional HSD17B13 protein. In yet another embodiment, the subject is heterozygous for the gene encoding a functional HSD17B13 protein and a gene encoding a loss of function variant of HSD17B13. In another embodiment, the subject is not a carrier of the HSD17B13 rs72613567 variant, e.g., HSD17B13 rs72613567:TA.

As used herein, the terms "treating" or "treatment" refer to a beneficial or desired result including, but not limited to, alleviation or amelioration of one or more symptoms associated with HSD17B13 gene expression and/or HSD17B13 protein production, e.g., an HSD17B13-associated disease, such as a chronic fibro-inflammatory liver disease, e.g., inflammation of the liver, liver fibrosis, nonalcoholic steatohepatitis (NASH), nonalcoholic fatty liver disease (NAFLD), cirrhosis of the liver, alcoholic steatohepatitis (ASH), alcoholic liver diseases (ALD), HCV-associated cirrhosis, drug induced liver injury, hepatocellular necrosis, and/or hepatocellular carcinoma. "Treatment" can also mean prolonging survival as compared to expected survival in the absence of treatment.

The term "lower" in the context of an HSD17B13-associated disease refers to a statistically significant decrease in such level. The decrease can be, for example, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more. In certain embodiments, a decrease is at least 20%. "Lower" in the context of the level of HSD17B13 in a subject is preferably down to a level accepted as within the range of normal for an individual without such disorder.

As used herein, "prevention" or "preventing," when used in reference to a disease, disorder or condition thereof, that would benefit from a reduction in expression of an HSD17B13 gene, refers to a reduction in the likelihood that a subject will develop a symptom associated with such disease, disorder, or condition, e.g., a symptom of HSD17B13 gene expression, such as inflammation of the liver, liver fibrosis, nonalcoholic steatohepatitis (NASH), nonalcoholic fatty liver disease (NAFLD), cirrhosis of the liver, alcoholic steatohepatitis (ASH), alcoholic liver diseases (ALD), HCV-associated cirrhosis, drug induced liver injury, hepatocellular necrosis, and/or hepatocellular carcinoma. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms (e.g., reduction in lipid accumulation in the liver and/or lipid droplet expansion in the liver) delayed (e.g., by days, weeks, months or years) is considered effective prevention.

As used herein, the term "HSD17B13-associated disease," is a disease or disorder that is caused by, or associated with, HSD17B13 gene expression or HSD17B13 protein production. The term "HSD17B13-associated disease" includes a disease, disorder or condition that would benefit from a decrease in HSD17B13 gene expression or protein activity.

In one embodiment, an "HSD17B13-associated disease" is a chronic fibro-inflammatory liver disease. A "chronic fibro-inflammatory liver disease" is any disease, disorder, or condition associated with chronic liver inflammation and/or fibrosis. Non-limiting examples of a chronic fibro-inflammatory liver disease include, for example, inflammation of the liver, liver fibrosis, nonalcoholic steatohepatitis (NASH), nonalcoholic fatty liver disease (NAFLD), cirrhosis of the liver, alcoholic steatohepatitis (ASH), alcoholic liver diseases (ALD), HCV-associated cirrhosis, drug induced liver injury, hepatocellular necrosis, and/or hepatocellular carcinoma.

"Therapeutically effective amount," as used herein, is intended to include the amount of an RNAi agent that, when administered to a subject having an HSD17B13-associated disease, disorder, or condition, is sufficient to effective treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an iRNA that, when administered to a subject having an HSD17B13-associated disease, disorder, or condition, is sufficient to prevent or ameliorate the disease or one or more symptoms of the disease. Ameliorating the disease includes slowing the course of the disease or reducing the severity of later-developing disease. The "prophylactically effective amount" may vary depending on the iRNA, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired local or systemic effect at a reasonable benefit/risk ratio applicable to any treatment. iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, and/or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to blood or plasma drawn from the subject.

II. iRNAs of the Invention

Described herein are iRNAs which inhibit the expression of a target gene. In one embodiment, the iRNAs inhibit the expression of an HSD17B13 gene. In one embodiment, the iRNA agent includes double stranded ribonucleic acid (dsRNA) molecules for inhibiting the expression of an HSD17B13 gene in a cell, such as a liver cell, such as a liver cell within a subject, e.g., a mammal, such as a human having a chronic fibro-inflammatory liver disease, disorder, or condition, e.g., a disease, disorder, or condition associated with, e.g., accumulation and/or expansion of lipid droplets in the liver and/or fibrosis of the liver.

The dsRNA includes an antisense strand having a region of complementarity which is complementary to at least a part of an mRNA formed in the expression of an HSD17B13 gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the target gene, the iRNA inhibits the expression of the target gene (e.g., a human, a primate, a non-primate, or a bird target gene) by at least about 10% as assayed by, for example, a PCR or branched DNA (bDNA)-based method, or by a protein-based method, such as by immunofluorescence analysis, using, for example, Western Blotting or flowcytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an HSD17B13 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the sense and antisense strands of the dsRNA are each independently about 15 to about 30 nucleotides in length, or about 25 to about 30 nucleotides in length, e.g., each strand is independently between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the dsRNA is between about 15 and about 23 nucleotides in length, or between about 25 and about 30 nucleotides in length. In general, the dsRNA is long enough to serve as a substrate for the Dicer enzyme. For example, it is well known in the art that dsRNAs longer than about 21-23 nucleotides can serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target HSD17B13 expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double-stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In one aspect, a dsRNA of the invention includes at least two nucleotide sequences, a sense sequence and an anti-sense sequence. The sense strand sequence is selected from the group of sequences provided in any one of Tables 2, 3, 7, 8, 10, 11 or 13, and the corresponding nucleotide sequence of the antisense strand of the sense strand is selected from the group of sequences of any one of Tables 2, 3, 7, 8, 10, 11, or 13. In this aspect, one of the two sequences is complementary to the other of the two sequences, with one of the sequences being substantially complementary to a sequence of an mRNA generated in the expression of an HSD17B13 gene. As such, in this aspect, a dsRNA will include two oligonucleotides, where one oligonucleotide is described as the sense strand (passenger strand) in any one of Tables 2, 3, 7, 8, 10, 11, or 13, and the second oligonucleotide is described as the corresponding antisense strand (guide strand) of the sense strand in any one of Tables 2, 3, 7, 8, 10, 11, or 13. In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in Tables 2, 3, 7, 8, 10, 11, or 13 are described as modified, unmodified, unconjugated. and/or conjugated sequences, the RNA of the iRNA of the invention e.g., a dsRNA of the invention, may comprise any one of the sequences set forth in any one of Tables 2, 3, 7, 8, 10, 11, or 13 that is un-modified, un-conjugated, and/or modified and/or conjugated differently than described therein.

The skilled person is well aware that dsRNAs having a duplex structure of between about 20 and 23 base pairs, e.g., 21, base pairs have been hailed as particularly effective in inducing RNA interference (Elbashir et al., (2001) *EMBO J.*, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided herein, dsRNAs described herein can include at least one strand of a length of minimally 21 nucleotides. It can be reasonably expected that shorter duplexes minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of an HSD17B13 gene by not more than about 5, 10, 15, 20, 25, or 30% inhibition from a dsRNA comprising the full sequence, are contemplated to be within the scope of the present invention.

In addition, the RNAs described in any one of Tables 2, 3, 7, 8, 10, 11, or 13 identify a site(s) in an HSD17B13 transcript that is susceptible to RISC-mediated cleavage. As such, the present invention further features iRNAs that target within this site(s). As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided herein coupled to additional nucleotide sequences taken from the region contiguous to the selected sequence in the gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified herein represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified herein, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA agent as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of an HSD17B13 gene, generally does not contain any mismatch within the central 13 nucleotides. The methods described herein or methods known in the art can be used to determine whether an iRNA containing a mismatch to a target sequence is effective in inhibiting the expression of an HSD17B13 gene. Consideration of the efficacy of iRNAs with mismatches in inhibiting expression of an HSD17B13 gene is important, especially if the particular region of complementarity in an HSD17B13 gene is known to have polymorphic sequence variation within the population.

III. Modified iRNAs of the Invention

In one embodiment, the RNA of the iRNA of the invention e.g., a dsRNA, is un-modified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified. iRNAs of the invention in which "substantially all of the nucleotides are modified" are largely but not wholly modified and can include not more than 5, 4, 3, 2, or 1 unmodified nucleotides.

In some aspects of the invention, substantially all of the nucleotides of an iRNA of the invention are modified and the iRNA agents comprise no more than 10 nucleotides comprising 2'-fluoro modifications (e.g., no more than 9 2'-fluoro modifications, no more than 8 2'-fluoro modifications, no more than 7 2'-fluoro modifications, no more than 6 2'-fluoro modifications, no more than 5 2'-fluoro modifications, no more than 4 2'-fluoro modifications, no more than 5 2'-fluoro modifications, no more than 4 2'-fluoro modifications, no more than 3 2'-fluoro modifications, or no more than 2 2'-fluoro modifications). For example, in some embodiments, the sense strand comprises no more than 4 nucleotides comprising 2'-fluoro modifications (e.g., no more than 3 2'-fluoro modifications, or no more than 2 2'-fluoro modifications). In other embodiments, the antisense strand comprises no more than 6 nucleotides comprising 2'-fluoro modifications (e.g., no more than 5 2'-fluoro modifications, no more than 4 2'-fluoro modifications, no more than 4 2'-fluoro modifications, or no more than 2 2'-fluoro modifications).

In other aspects of the invention, all of the nucleotides of an iRNA of the invention are modified and the iRNA agents comprise no more than 10 nucleotides comprising 2'-fluoro modifications (e.g., no more than 9 2'-fluoro modifications, no more than 8 2'-fluoro modifications, no more than 7 2'-fluoro modifications, no more than 6 2'-fluoro modifications, no more than 5 2'-fluoro modifications, no more than 4 2'-fluoro modifications, no more than 5 2'-fluoro modifications, no more than 4 2'-fluoro modifications, no more than 3 2'-fluoro modifications, or no more than 2 2'-fluoro modifications).

In one embodiment, the double stranded RNAi agent of the invention further comprises a 5'-phosphate or a 5'-phosphate mimic at the 5' nucleotide of the antisense strand. In another embodiment, the double stranded RNAi agent further comprises a 5'-phosphate mimic at the 5' nucleotide of the antisense strand. In a specific embodiment, the 5'-phosphate mimic is a 5'-vinyl phosphate (5'-VP).

The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6, 239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science,* 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-OCH$_3$), 2'-aminopropoxy (2'-OCH$_2$CH$_2$CH$_2$NH$_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA of the invention can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) *Angewandte Chemie, International Edition,* 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

An iRNA of the invention can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

An iRNA of the invention can also be modified to include one or more bicyclic sugar moieties. A "bicyclic sugar" is a furanosyl ring modified by the bridging of two atoms. A"bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elnen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C (CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O-N(CH3)-2' (see, e.g., U.S. Patent Publication No. 2004/0171570); 4'-CH2-N(R)-O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.,* 2009, 74, 118-134); and 4'-CH2-C(=CH2)-2'

(and analogs thereof; see, e.g., U.S. Pat. No. 8,278,426). The entire contents of each of the foregoing are hereby incorporated herein by reference.

Additional representative U.S. patents and U.S. patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

An iRNA of the invention can also be modified to include one or more constrained ethyl nucleotides. As used herein, a "constrained ethyl nucleotide" or "cEt" is a locked nucleic acid comprising a bicyclic sugar moiety comprising a 4'-CH (CH3)-0-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and -C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of an iRNA of the invention include a 5' phosphate or 5' phosphate mimic, e.g., a 5'-terminal phosphate or phosphate mimic on the antisense strand of an RNAi agent. Suitable phosphate mimics are disclosed in, for example US Patent Publication No. 2012/0157511, the entire contents of which are incorporated herein by reference.

In certain specific embodiments, an RNAi agent of the present invention is an agent that inhibits the expression of an HSD17B13 gene which is selected from the group of agents listed in any one of Tables 2, 3, 7, 8, 10, 11, or 13. Any of these agents may further comprise a ligand.

A. Modified iRNAs Comprising Motifs of the Invention

In certain aspects of the invention, the double stranded RNAi agents of the invention include agents with chemical modifications as disclosed, for example, in WO 2013/075035, filed on Nov. 16, 2012, the entire contents of which are incorporated herein by reference.

Accordingly, the invention provides double stranded RNAi agents capable of inhibiting the expression of a target gene (i.e., an HSD17B13 gene) in vivo. The RNAi agent comprises a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length. In one embodiment, the sense strand is 21 nucleotides in length. In one embodiment, the antisense strand is 23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-Omethyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3-terminal end of the sense strand or, alternatively, at the 3-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (preferably GalNAc$_3$).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand.

For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAA-BAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3' of the strand within the duplex region. As another example, the alternating motif in the sense strand may start with "AABBAABB" from 5'-3' of the strand and the alternating motif in the antisenese strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing activity to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both strands in any position of the strand. For instance, the internucleotide linkage modification may occur on every nucleotide on the sense strand and/or antisense strand; each internucleotide linkage modification may occur in an alternating pattern on the sense strand and/or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8phosphorothioate internucleotide linkages. In one embodiment, the antisense strand comprises two phosphorothioate internucleotide linkages at the 5'-terminus and two phosphorothioate internucleotide linkages at the 3'-terminus, and the sense strand comprises at least two phosphorothioate internucleotide linkages at either the 5'-terminus or the 3'-terminus.

In one embodiment, the RNAi comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, and/or the 5'end of the antisense strand.

In one embodiment, the 2 nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the RNAi agent may additionally have two phosphorothioate internucleotide linkages between the terminal three nucleotides at both the 5'-end of the sense strand and at the 5'-end of the antisense strand.

In one embodiment, the RNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, J:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense and/or antisense strand.

In one embodiment, the sense strand sequence may be represented by formula (I):

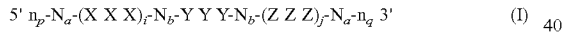

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each np and $n_q$ independently represent an overhang nucleotide;
wherein Nb and Y do not have the same modification; and
XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the st nucleotide, from the 5'-end; or optionally, the count starting at the 1$^{st}$ paired nucleotide within the duplex region, from the 5'-end.

In one embodiment, i is 1 and j is 0, or i is 0 and j is 1, or both i and j are 1. The sense strand can therefore be represented by the following formulas:

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each Na can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

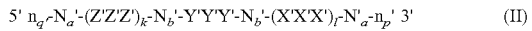

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b'$ and Y' do not have the same modification; and
X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23nucleotide in length, the Y'Y'Y' motif can occur at positions 9, 10, 11; 10, 11, 12; 11, 12, 13; 12, 13, 14; or 13, 14, 15 of the antisense strand, with the count starting from the 1$^{st}$ nucleotide, from the 5'-end; or optionally, the count starting at the 1$^{st}$ paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

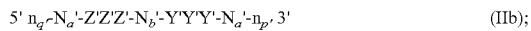 (IIb);

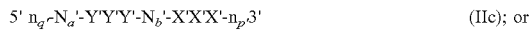 (IIc); or

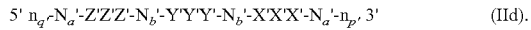 (IId).

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

 (Ia).

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1st nucleotide from the 5'-end, or optionally, the count starting at the 1st paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1st nucleotide from the 5' end, or optionally, the count starting at the 1st paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

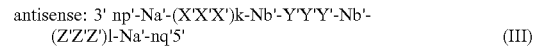 (III)

wherein:

i, j, k, and l are each independently 0 or 1;
p, p', q, and q' are each independently 0-6;
each Na and Na' independently represents an oligonucleotide sequence comprising 0-25 modified nucleotides, each sequence comprising at least two differently modified nucleotides;
each Nb and Nb' independently represents an oligonucleotide sequence comprising 0-10 modified nucleotides;
wherein each np', np, nq', and nq, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

 (IIIa)

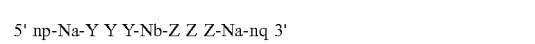

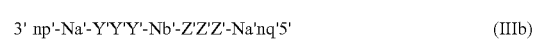 (IIIb)

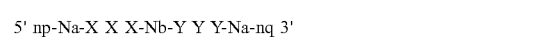

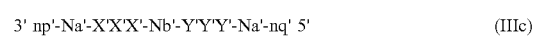 (IIIc)

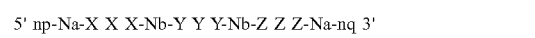

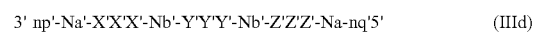 (IIId)

When the RNAi agent is represented by formula (IIIa), each Na independently represents an oligonucleotide sequence comprising 2-20, 2-15, or 2-10 modified nucleotides.

When the RNAi agent is represented by formula (IIIb), each Nb independently represents an oligonucleotide sequence comprising 1-10, 1-7, 1-5 or 1-4 modified nucleotides. Each Na independently represents an oligonucleotide sequence comprising 2-20, 2-15, or 2-10 modified nucleotides.

When the RNAi agent is represented as formula (IIIc), each Nb, Nb' independently represents an oligonucleotide sequence comprising 0-10, 0-7, 0-10, 0-7, 0-5, 0-4, 0-2 or 0 modified nucleotides. Each Na independently represents an oligonucleotide sequence comprising 2-20, 2-15, or 2-10 modified nucleotides.

When the RNAi agent is represented as formula (IIId), each Nb, Nb' independently represents an oligonucleotide sequence comprising 0-10, 0-7, 0-10, 0-7, 0-5, 0-4, 0-2 or 0 modified nucleotides. Each Na, Na' independently represents an oligonucleotide sequence comprising 2-20, 2-15, or 2-10 modified nucleotides. Each of Na, Na', Nb and Nb' independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the Na modifications are 2'-O-methyl or 2'-fluoro modifications. In another embodiment, when the RNAi agent is represented by formula (IIId), the Na modifications are 2'-O-methyl or 2'-fluoro modifications and np'>0 and at least one np' is linked to a neighboring nucleotide a via phosphorothioate linkage. In yet another embodiment, when the RNAi agent is represented by formula (IIId), the Na modifications are 2'-O-methyl or 2'-fluoro modifications, np'>0 and at least one np' is linked to a neighboring nucleotide via phosphorothioate linkage, and the sense strand is conjugated to one or more GalNAc derivatives attached through a bivalent or trivalent branched linker (described below). In another embodiment, when the RNAi agent is represented by formula (IIId), the Na modifications are 2'-O-methyl or 2'-fluoro modifications, np'>0 and at least one np' is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIIa), the Na modifications are 2'-O-methyl or 2'-fluoro modifications, np'>0 and at least one np' is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric RNAi agents that can be used in the methods of the invention. Such publications include WO2007/091269, U.S. Pat. No. 7,858, 769, WO2010/141511, WO2007/117686, WO2009/014887 and WO2011/031520 the entire contents of each of which are hereby incorporated herein by reference.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and and decalin; preferably, the acyclic group is selected from serinol backbone or diethanolamine backbone.

In another embodiment of the invention, an iRNA agent comprises a sense strand and an antisense strand, each strand having 14 to 40 nucleotides. The RNAi agent may be represented by formula (L):

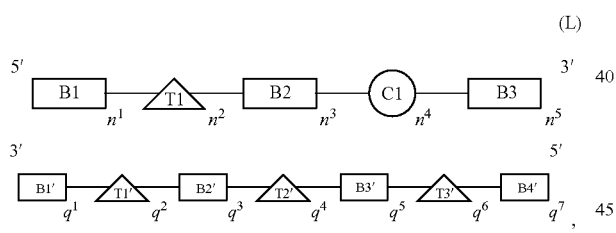

(L)

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In certain embodiments, B1, B2, B3, B1', B2', B3', and B4' each contain 2'-OMe modifications. In certain embodiments, B1, B2, B3, B1', B2', B3', and B4' each contain 2'-OMe or 2'-F modifications. In certain embodiments, at least one of B1, B2, B3, B1', B2', B3', and B4' contain 2'-O-N-methylacetamido (2'-O-NMA) modification.

C1 is a thermally destabilizing nucleotide placed at a site opposite to the seed region of the antisense strand (i.e., at positions 2-8 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In certain embodiments, C1 has thermally destabilizing modification selected from the group consisting of: i) mismatch with the opposing nucleotide in the antisense strand; ii) abasic modification selected from the group consisting of:

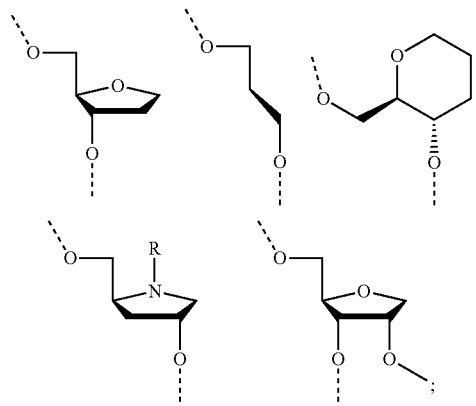

and iii) sugar modification selected from the group consisting of:

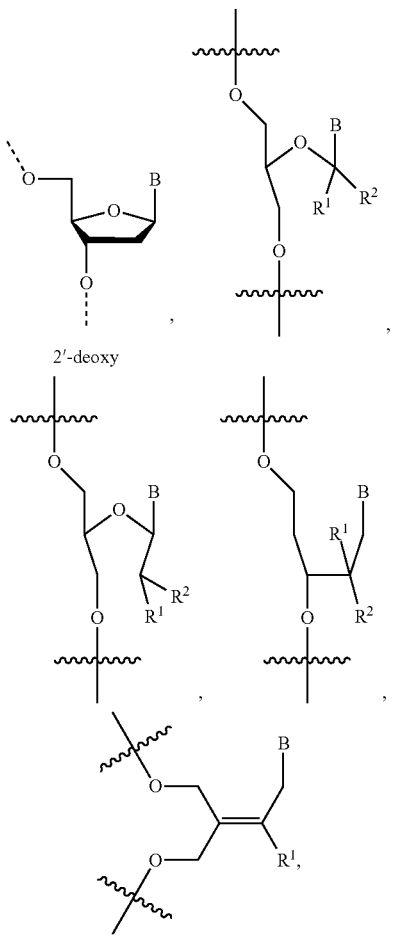

and

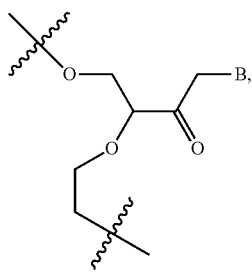

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar. In certain embodiments, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

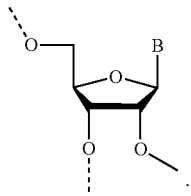

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In certain embodiments, T1 is DNA. In certain embodiments, T1' is DNA, RNA or LNA. In certain embodiments, T2' is DNA or RNA. In certain embodiments, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length. Alternatively, $n^4$ is 0-3 nucleotide(s) in length.

In certain embodiments, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, $n^4$, $q^2$, and $q^6$ are each 1.

In certain embodiments, $n^2$, $n^4$, $q^2$, $q^4$, and $q^6$ are each 1.

In certain embodiments, C1 is at position 14-17 of the 5'-end of the sense strand, when the sense strand is 19-22 nucleotides in length, and $n^4$ is 1. In certain embodiments, C1 is at position 15 of the 5'-end of the sense strand In certain embodiments, T3' starts at position 2 from the 5' end of the antisense strand. In one example, T3' is at position 2 from the 5' end of the antisense strand and $q^6$ is equal to 1.

In certain embodiments, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In certain embodiments, T1' and T3' are separated by 11 nucleotides in length (i.e. not counting the T1' and T3' nucleotides).

In certain embodiments, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In certain embodiments, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In certain embodiments, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In certain embodiments, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In certain embodiments, T2' starts at position 8 from the 5' end of the antisense strand. In one example, T2' starts at position 8 from the 5' end of the antisense strand, and $q^4$ is 2.

In certain embodiments, T2' starts at position 9 from the 5' end of the antisense strand. In one example, T2' is at position 9 from the 5' end of the antisense strand, and $q^4$ is 1.

In certain embodiments, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In certain embodiments, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-$PS_2$), 5'-end vinylphosphonate (5'-VP), 5'-end methylphosphonate (MePhos), or 5'-deoxy-5'-C-malonyl

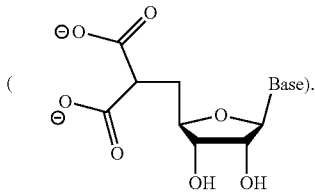

When the 5'-end phosphorus-containing group is 5'-end vinylphosphonate (5'-VP), the 5'-VP can be either 5'-E-VP isomer (i.e., trans-vinylphosphate,

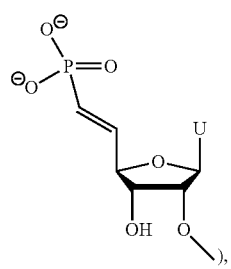

5'-Z-VP isomer (i.e., cis-vinylphosphate,

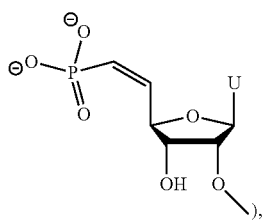

or mixtures thereof.

In certain embodiments, the RNAi agent comprises a phosphorus-containing group at the 5'-end of the sense strand. In certain embodiments, the RNAi agent comprises a phosphorus-containing group at the 5'-end of the antisense strand.

In certain embodiments, the RNAi agent comprises a 5'-P. In certain embodiments, the RNAi agent comprises a 5'-P in the antisense strand.

In certain embodiments, the RNAi agent comprises a 5'-PS. In certain embodiments, the RNAi agent comprises a 5'-PS in the antisense strand.

In certain embodiments, the RNAi agent comprises a 5'-VP. In certain embodiments, the RNAi agent comprises a 5'-VP in the antisense strand. In certain embodiments, the RNAi agent comprises a 5'-E-VP in the antisense strand. In certain embodiments, the RNAi agent comprises a 5'-Z-VP in the antisense strand.

In certain embodiments, the RNAi agent comprises a 5'-$PS_2$. In certain embodiments, the RNAi agent comprises a 5'-$PS_2$ in the antisense strand.

In certain embodiments, the RNAi agent comprises a 5'-$PS_2$. In certain embodiments, the RNAi agent comprises a 5'-deoxy-5'-C-malonyl in the antisense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^1$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^1$ is 1, B4' is 2'-OMe, and $q^7$ is 1. The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-PS$_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z-VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNA RNA agent also comprises a 5'-PS$_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In certain embodiments, the 5'-P is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In certain embodiments, the 5'-PS is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof), and a targeting ligand.

In certain embodiments, the 5'-VP is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In certain embodiments, the 5'-$PS_2$ is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In certain embodiments, the 5'-deoxy-5'-C-malonyl is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In certain embodiments, the 5'-P is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In certain embodiments, the 5'-PS is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z-VP, or combination thereof) and a targeting ligand. In certain embodiments, the 5'-VP is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-$PS_2$ and a targeting ligand. In certain embodiments, the 5'-$PS_2$ is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In certain embodiments, the 5'-deoxy-5'-C-malonyl is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In certain embodiments, the 5'-P is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In certain embodiments, the 5'-PS is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In certain embodiments, the 5'-VP is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In certain embodiments, the 5'-$PS_2$ is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In certain embodiments, the 5'-deoxy-5'-C-malonyl is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In certain embodiments, the 5'-P is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In certain embodiments, the 5'-PS is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In certain embodiments, the 5'-VP is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In certain embodiments, the 5'-$PS_2$ is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In certain embodiments, the 5'-deoxy-5'-C-malonyl is at the 5'-end of the antisense strand, and the targeting ligand is at the 3'-end of the sense strand.

In a particular embodiment, an RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker; and
(iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end);
and
(b) an antisense strand having:
(i) a length of 23 nucleotides;
(ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and (iii) phosphorothioate internucleotide linkages between nucleotide positions 21 and 22, and between nucleotide positions 22 and 23 (counting from the 5' end);

wherein the dsRNA agents have a two-nucleotide overhang at the 3'-end of the antisense strand, and a blunt end at the 5'-end of the antisense strand.

In another particular embodiment, an RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
  - (iv) phosphorothioate internucleotide linkages between nucleotide positions 1 and 2, and between nucleotide positions 2 and 3 (counting from the 5' end); and
- (b) an antisense strand having:
  - (i) a length of 23 nucleotides;
  - (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
  - (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, an RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-OMe modifications at positions 1 to 6, 8, 10, and 12 to 21, 2'-F modifications at positions 7, and 9, and a desoxy-nucleotide (e.g. dT) at position 11 (counting from the 5' end); and
  - (iv) phosphorothioate internucleotide linkages between nucleotide positions 1 and 2, and between nucleotide positions 2 and 3 (counting from the 5' end); and
- (b) an antisense strand having:
  - (i) a length of 23 nucleotides;
  - (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
  - (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, an RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-OMe modifications at positions 1 to 6, 8, 10, 12, 14, and 16 to 21, and 2'-F modifications at positions 7, 9, 11, 13, and 15; and
  - (iv) phosphorothioate internucleotide linkages between nucleotide positions 1 and 2, and between nucleotide positions 2 and 3 (counting from the 5' end); and
- (b) an antisense strand having:
  - (i) a length of 23 nucleotides;
  - (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
  - (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, an RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-OMe modifications at positions 1 to 9, and 12 to 21, and 2'-F modifications at positions 10, and 11; and
  - (iv) phosphorothioate internucleotide linkages between nucleotide positions 1 and 2, and between nucleotide positions 2 and 3 (counting from the 5' end); and
- (b) an antisense strand having:
  - (i) a length of 23 nucleotides;
  - (ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
  - (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, a RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-F modifications at positions 1, 3, 5, 7, 9 to 11, and 13, and 2'-OMe modifications at positions 2, 4, 6, 8, 12, and 14 to 21; and
  - (iv) phosphorothioate internucleotide linkages between nucleotide positions 1 and 2, and between nucleotide positions 2 and 3 (counting from the 5' end);

and
(b) an antisense strand having:
(i) a length of 23 nucleotides;
(ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two-nucleotide overhang at the 3'-end of the antisense strand, and a blunt end at the 5'-end of the antisense strand.

In another particular embodiment, an RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
(iv) phosphorothioate internucleotide linkages between nucleotide positions 1 and 2, and between nucleotide positions 2 and 3 (counting from the 5' end); and
(b) an antisense strand having:
(i) a length of 25 nucleotides;
(ii) 2'-OMe modifications at positions 1, 4, 6, 7, 9, 11 to 13, 15, 17, and 19 to 23, 2'-F modifications at positions 2, 3, 5, 8, 10, 14, 16, and 18, and desoxy-nucleotides (e.g. dT) at positions 24 and 25 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a four-nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two-nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end);
and
(b) an antisense strand having:
(i) a length of 23 nucleotides;
(ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two-nucleotide overhang at the 3'-end of the antisense strand, and a blunt end at the 5'-end of the antisense strand.

In another particular embodiment, a RNAi agent of the present invention comprises:
(a) a sense strand having:
(i) a length of 19 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 4, 6, and 10 to 19, and 2'-F modifications at positions 5, and 7 to 9; and
(iv) phosphorothioate internucleotide linkages between nucleotide positions 1 and 2, and between nucleotide positions 2 and 3 (counting from the 5' end);
and
(b) an antisense strand having:
(i) a length of 21 nucleotides;
(ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 19 and 20, and between nucleotide positions 20 and 21 (counting from the 5' end);
wherein the RNAi agents have a two-nucleotide overhang at the 3'-end of the antisense strand, and a blunt end at the 5'-end of the antisense strand.

In certain embodiments, the iRNA for use in the methods of the invention is an agent selected from agents listed in Tables 2, 3, 7, 8, 10, 11, or 13. In one embodiment, the agent is AD-288917. In another embodiment, the agent is AD-288996. In another embodiment, the agent is AD-413639. In one embodiment, the agent is AD-413644. In another embodiment, the agent is AD-413669. These agents may further comprise a ligand.

IV. iRNAs Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., (1989) *Proc. Natl. Acid. Sci. USA,* 86: 6553-6556), cholic acid (Manoharan et al., (1994) *Biorg. Med. Chem. Let.,* 4:1053-1060), a thioether, e.g., beryl-S-tritylthiol (Manoharan et al., (1992) *Ann. N. Y. Acad. Sci.,* 660:306-309; Manoharan et al., (1993) *Biorg. Med. Chem. Let.,* 3:2765-2770), a thiocholesterol (Oberhauser et al., (1992) *Nucl. Acids Res.,* 20:533-538), an aliphatic chain, e.g., dodecandiol or undecyl residues (Saison-Behmoaras et al., (1991) *EMBO J,* 10:1111-1118; Kabanov et al., (1990) *FEBS Lett.,* 259:327-330; Svinarchuk et al., (1993) *Biochimie,* 75:49-54), a phospholipid, e.g., di-hexadecyl-rac-glycerol or triethyl-ammonium 1,2-di-O-hexadecyl-rac-glycero-3-phosphonate (Manoharan et al., (1995) *Tetrahedron Lett.,* 36:3651-3654; Shea et al., (1990) *Nucl. Acids Res.,* 18:3777-3783), a polyamine or a polyethylene glycol chain (Manoharan et al., (1995) *Nucleosides & Nucleotides,* 14:969-973), or adamantane acetic acid (Manoharan et al., (1995) *Tetrahedron Lett.,* 36:3651-3654), a palmityl moiety (Mishra et al., (1995) *Biochim. Biophys. Acta,* 1264:229-237), or an octadecylamine or hexylaminocarbonyloxycholesterol moiety (Crooke et al., (1996) *J. Pharmacol. Exp. Ther.,* 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacrylic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conujugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells.

Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 2977). An RFGF analogue (e.g., amino acid sequence AALLPVLLAAP (SEQ ID NO:2978) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 2979) and the Drosophila Antennapedia protein (RQIKIWFQNRRMKWKK (SEQ ID NO: 2980) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidomimetics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, a α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the invention is selected from the group consisting of:

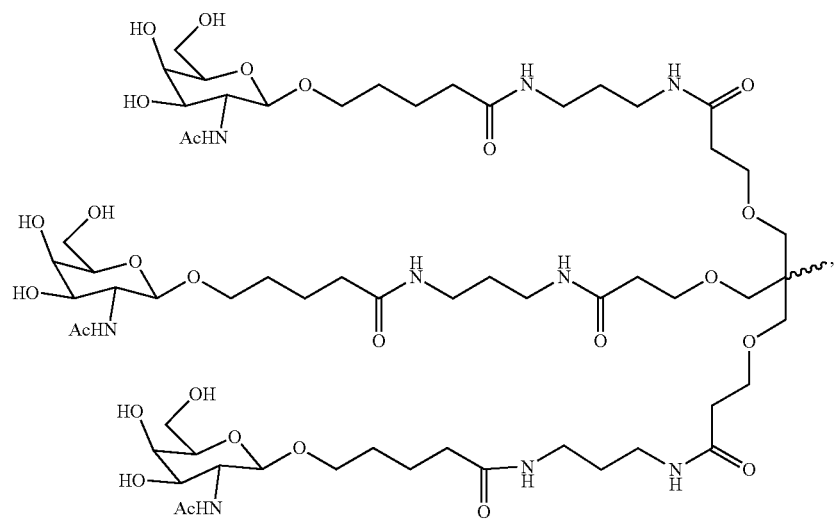

Formula II

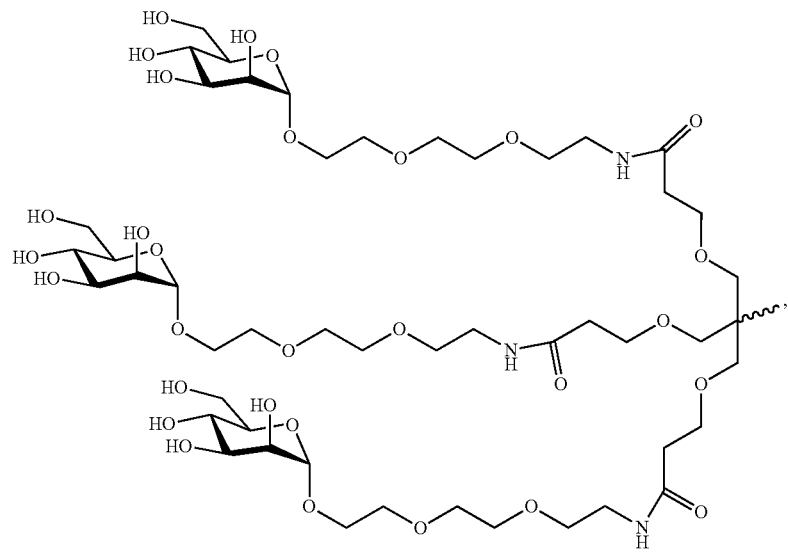

Formula III

-continued
Formula IV
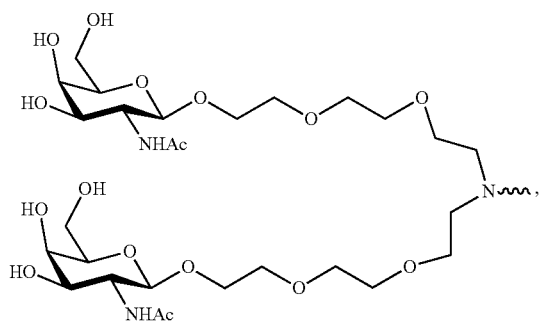
Formula V
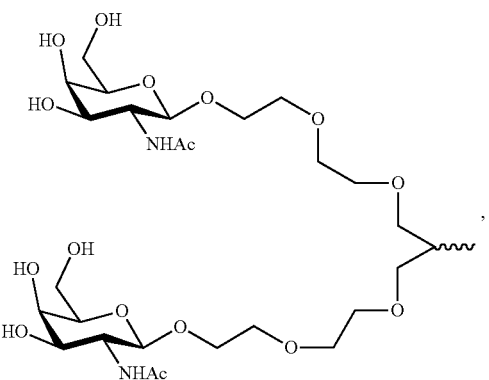
Formula VI
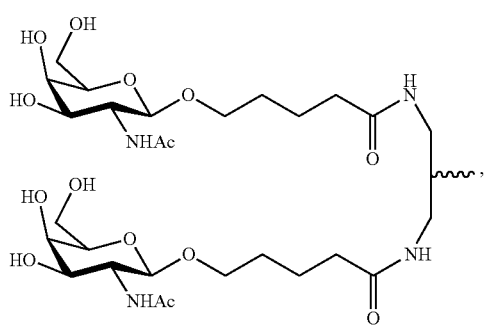
Formula VII
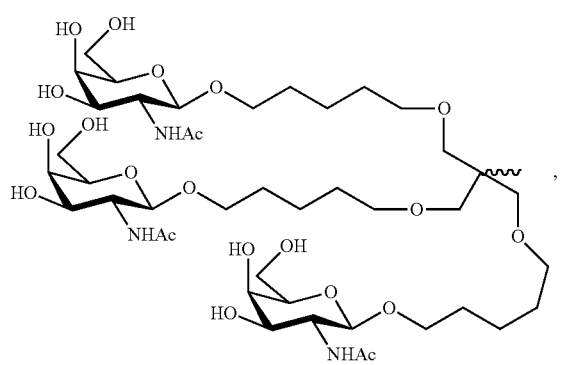
Formula VIII
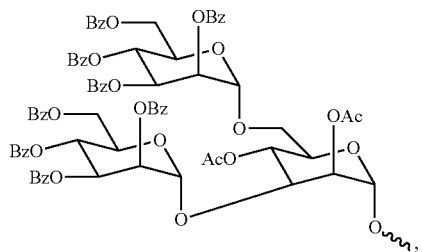
Formula IX
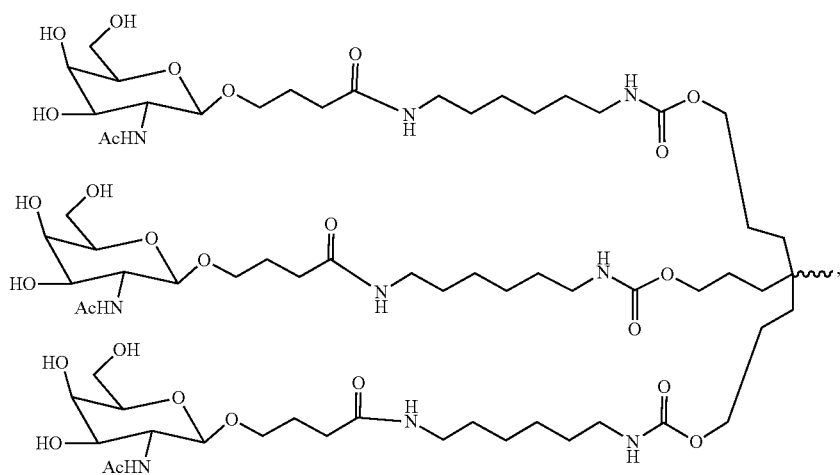

Formula X
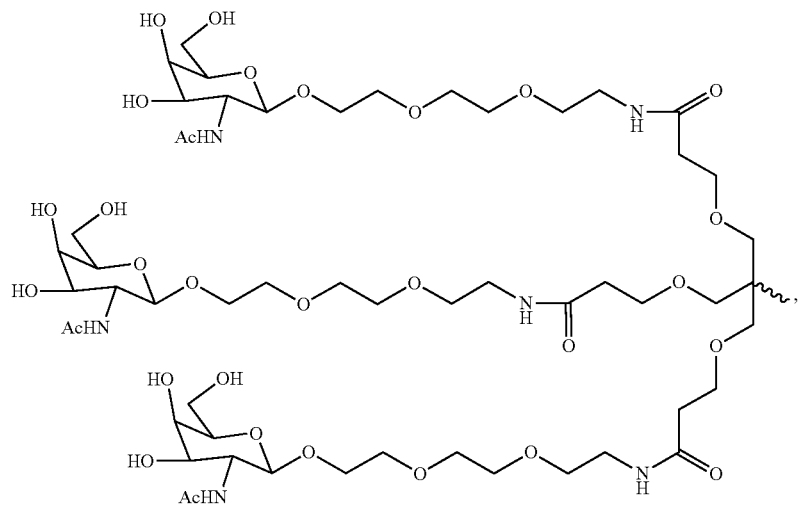
Formula XI
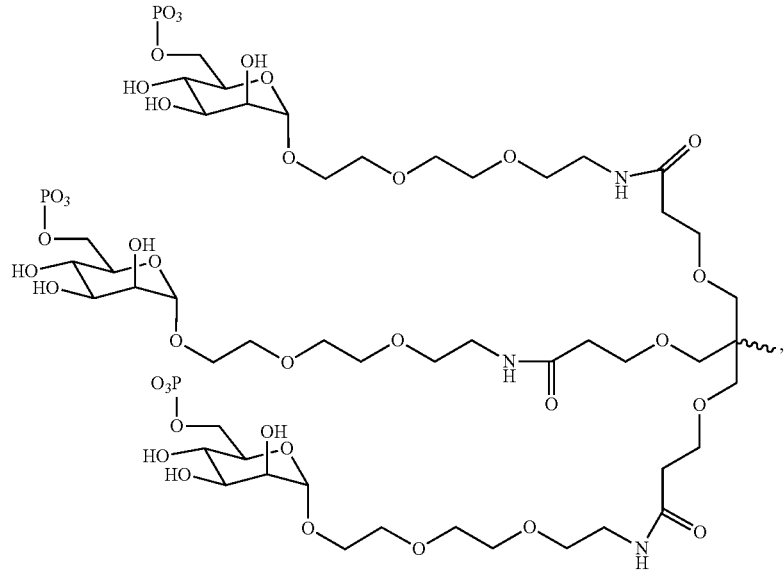
Formula XII
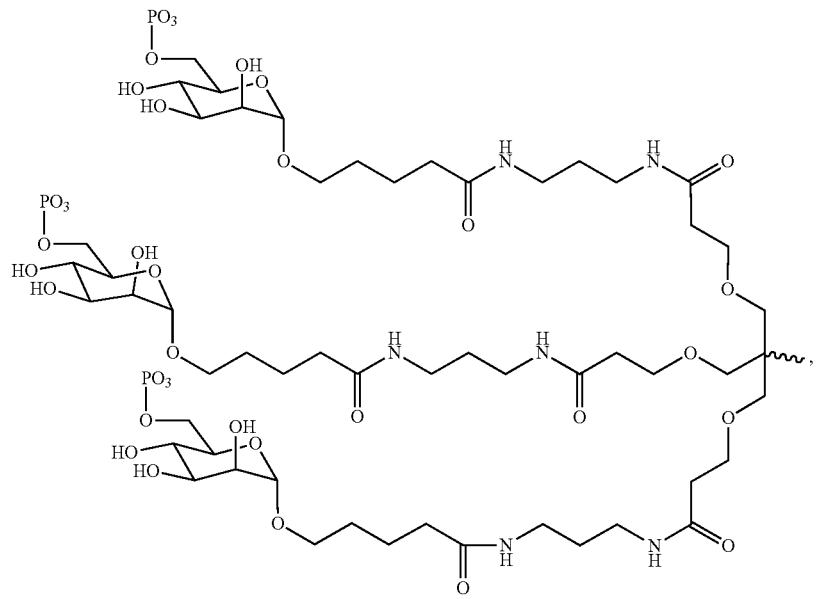

-continued
Formula XIII
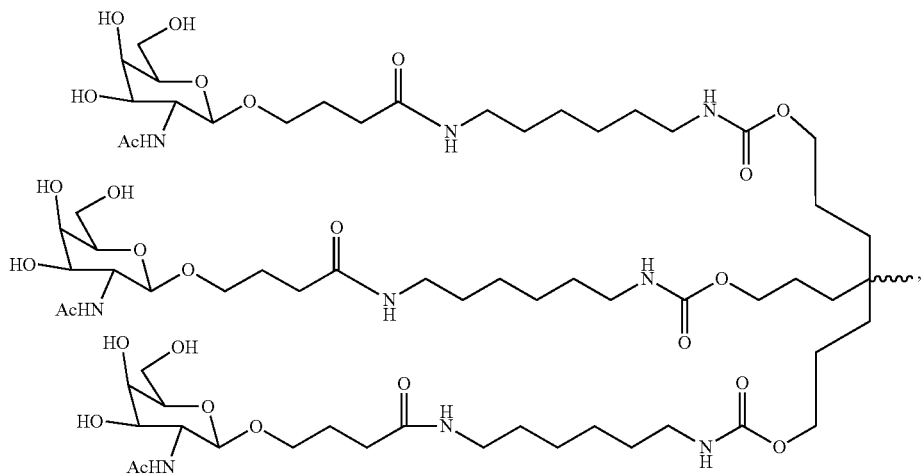
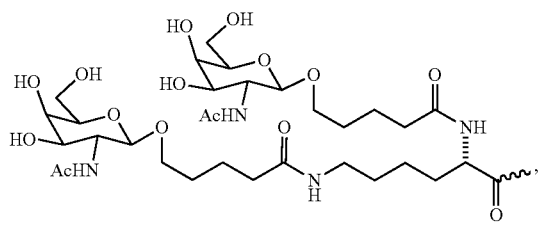
Formula XIV
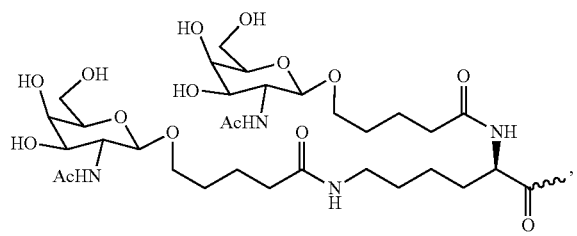
Formula XV
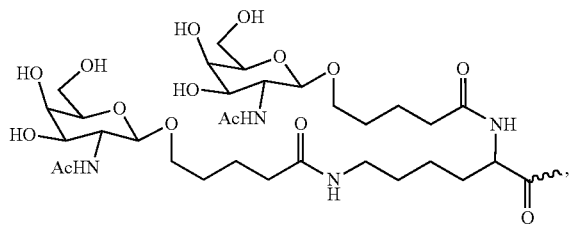
Formula XVI
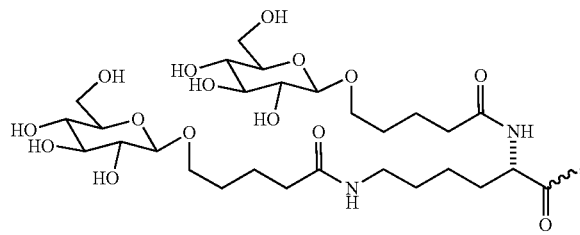
Formula XVII
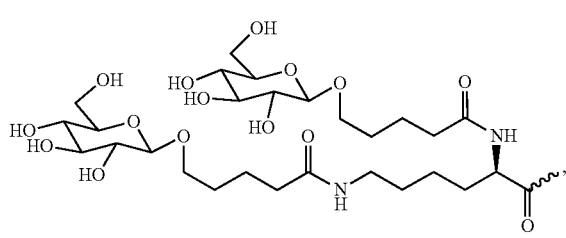
Formula XVIII
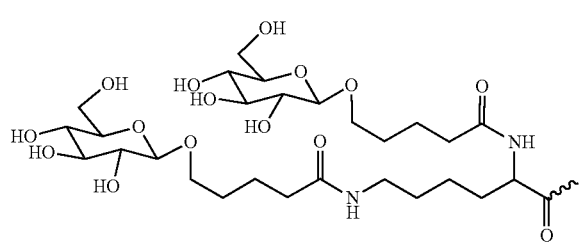
Formula XIX
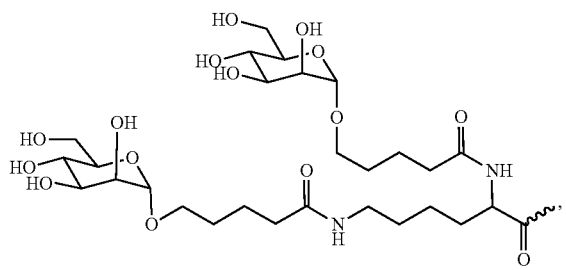
Formula XX
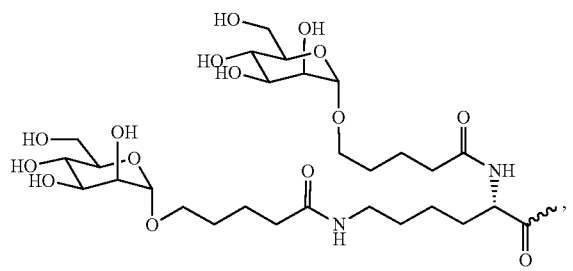
Formula XXI -continued
Formula XXII
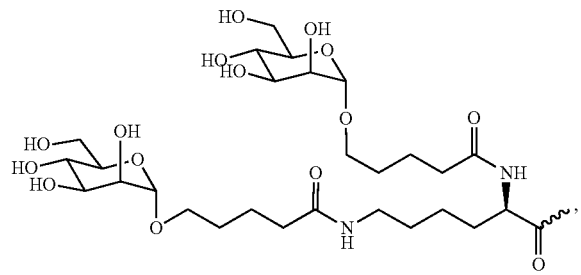
Formula XXIII
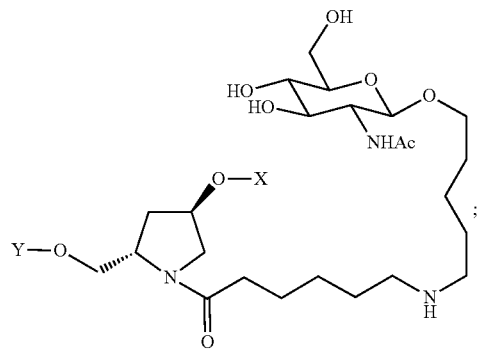
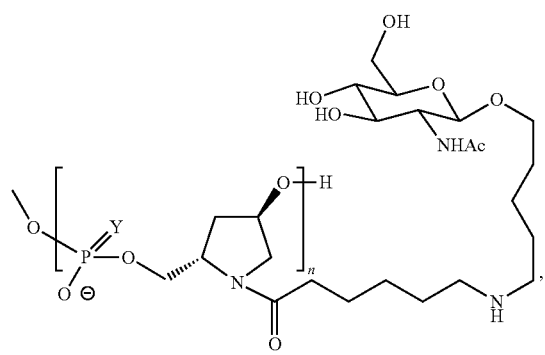
wherein Y is O or S and n is 3-6 (Formula XXIV);
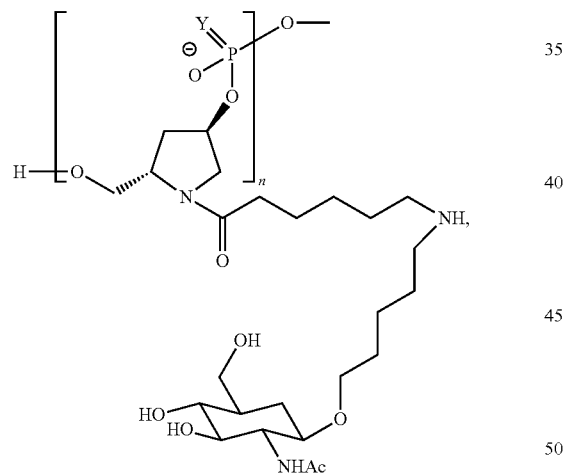
wherein Y is O or S and n is 3-6 (Formula XXV);
Formula XXVI
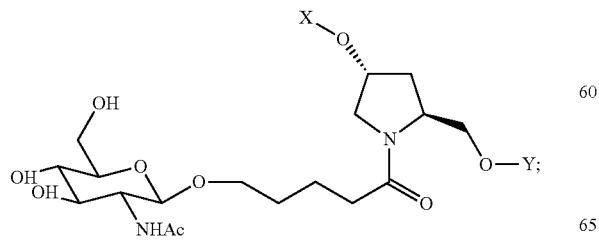

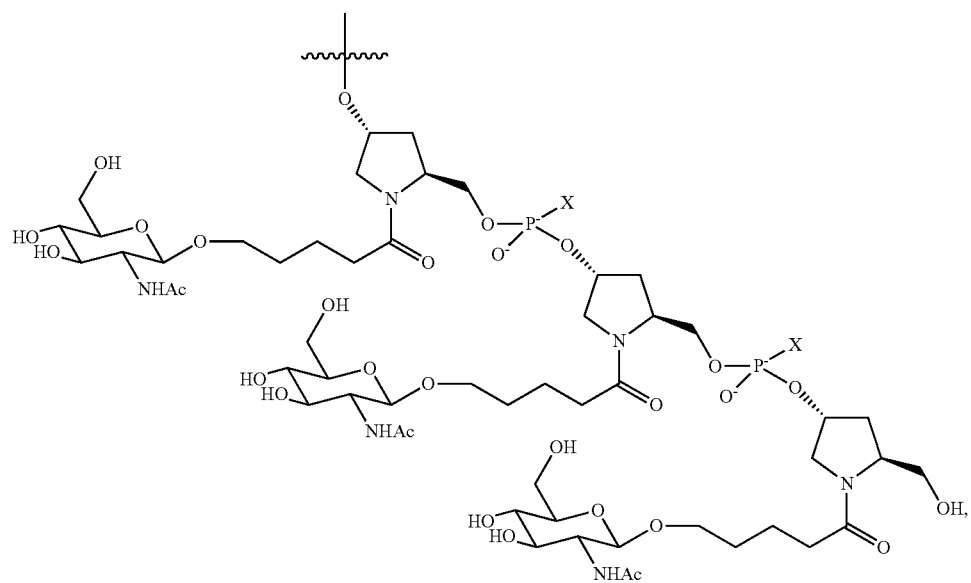
wherein X is O or S (Formula XXVII);
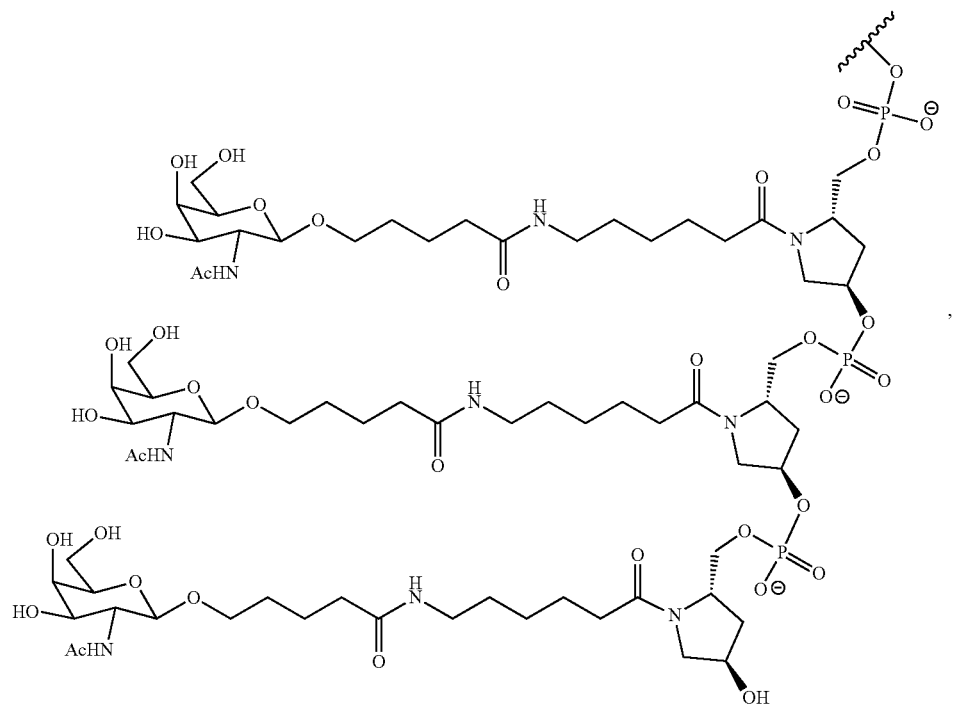

-continued
Formula XXIX
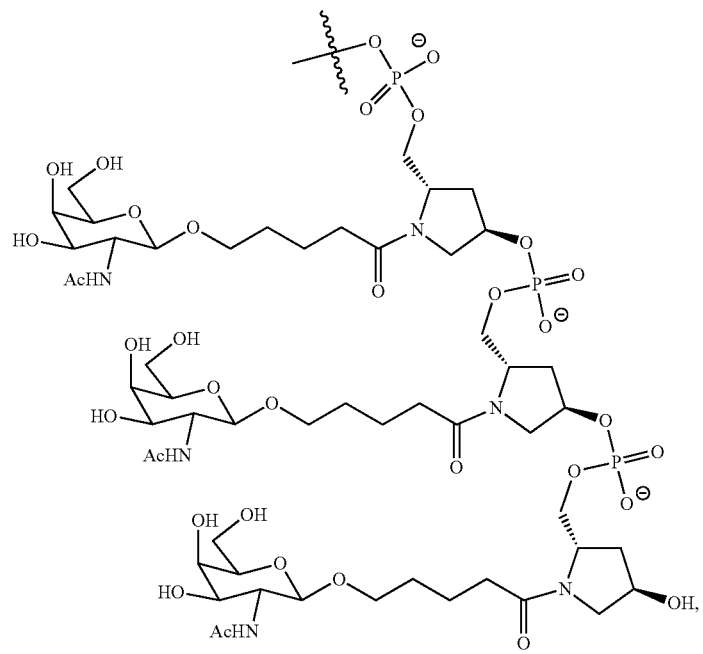
Formula XXX
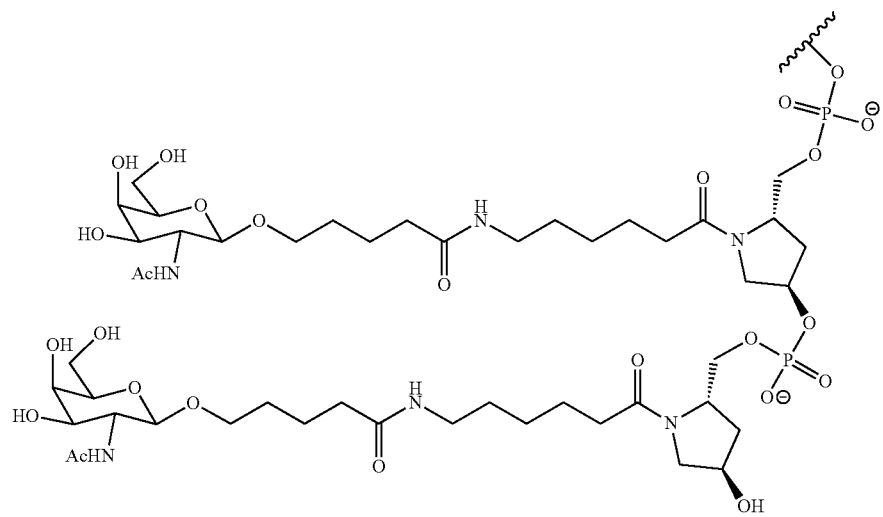
Formula XXXI
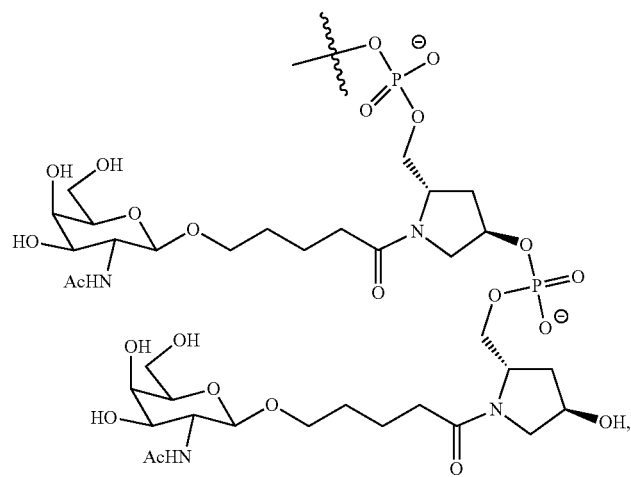

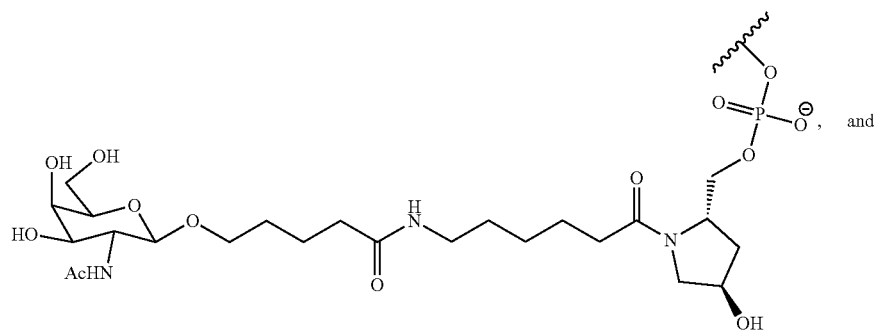
Formula XXXII
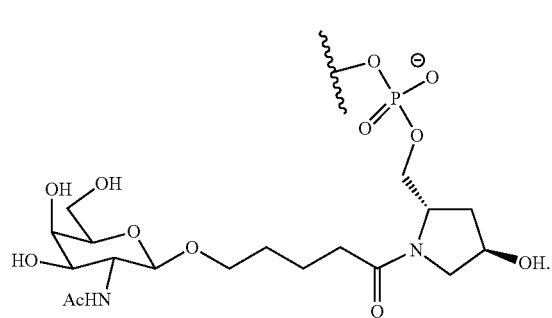
Formula XXXIII
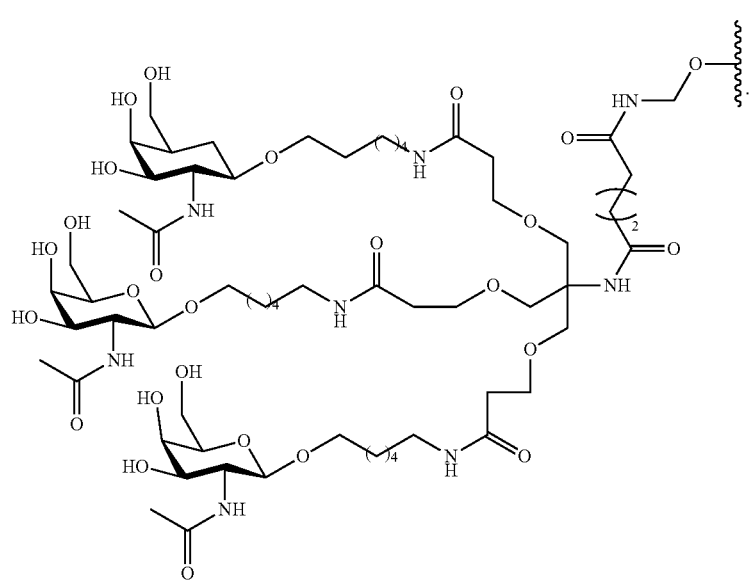
Formula XXXIV

Formula II

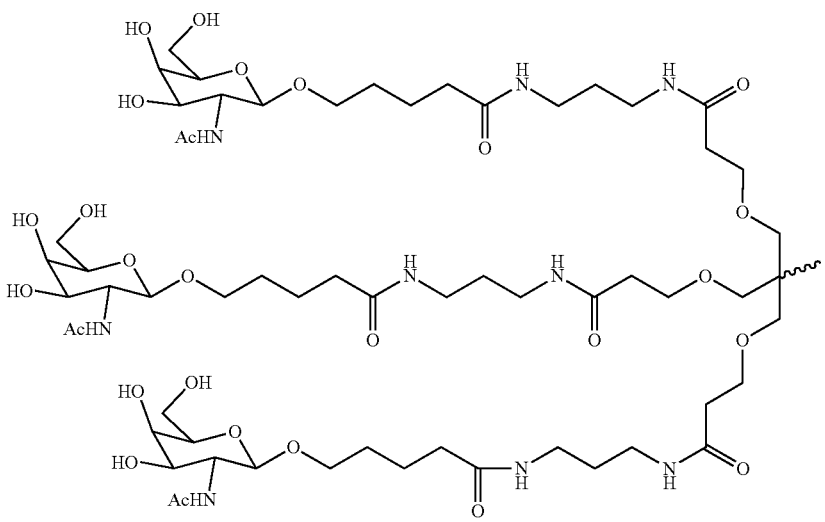

In another embodiment, a carbohydrate conjugate for use in the compositions and methods of the invention is a monosaccharide. In one embodiment, the monosaccharide is an N-acetylgalactosamine, such as Another representative carbohydrate conjugate for use in the embodiments described herein includes, but is not limited to, In one embodiment, the double stranded RNAi agents of the invention comprise one GalNAc or GalNAc derivative attached to the iRNA agent, e.g., the 3' or 5'end of the sense strand of a dsRNA agent as described herein. In another embodiment, the double stranded RNAi agents of the invention comprise a plurality (e.g., 2, 3, 4, 5, or 6) of GalNAc or GalNAc derivatives, each independently attached to a plurality of nucleotides of the double stranded RNAi agent through a plurality of monovalent linkers.

(Formula XXXVI)

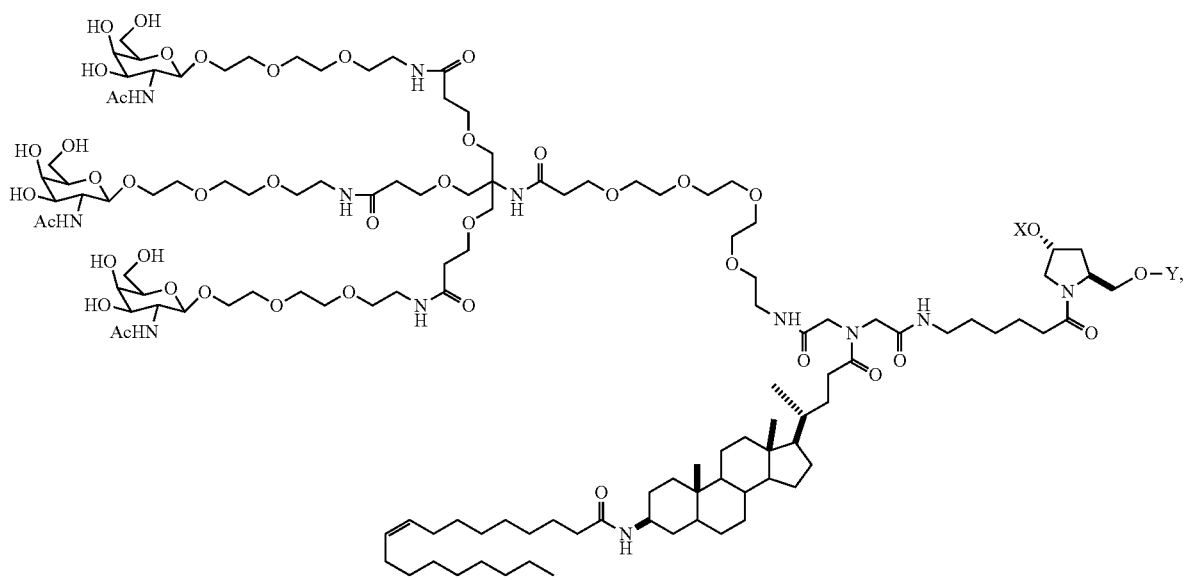

when one of X or Y is an oligonucleotide, the other is a hydrogen.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator and/or a cell permeation peptide.

Additional carbohydrate conjugates (and linkers) suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood.

In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to, (Formula XXXVII)

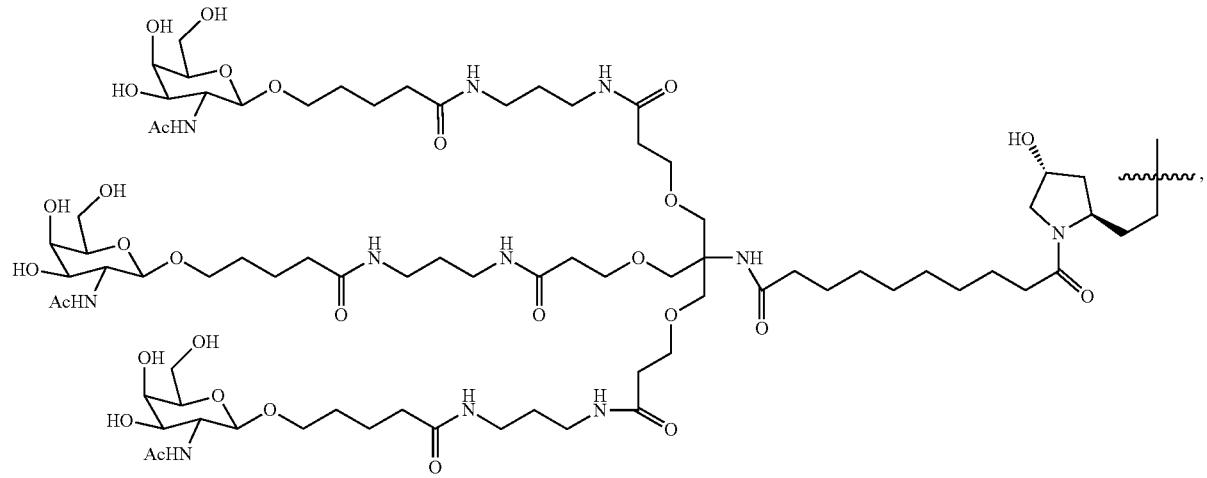

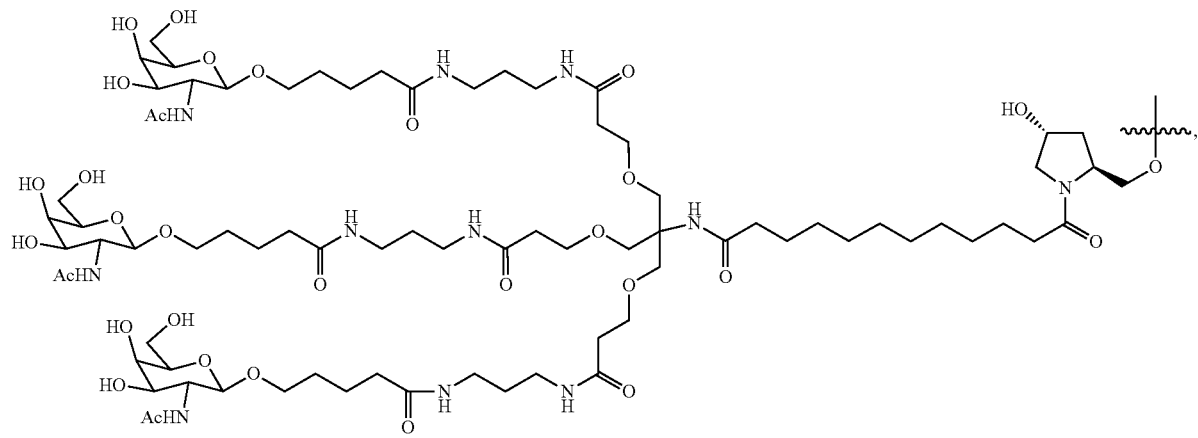
(Formula XXXVIII)
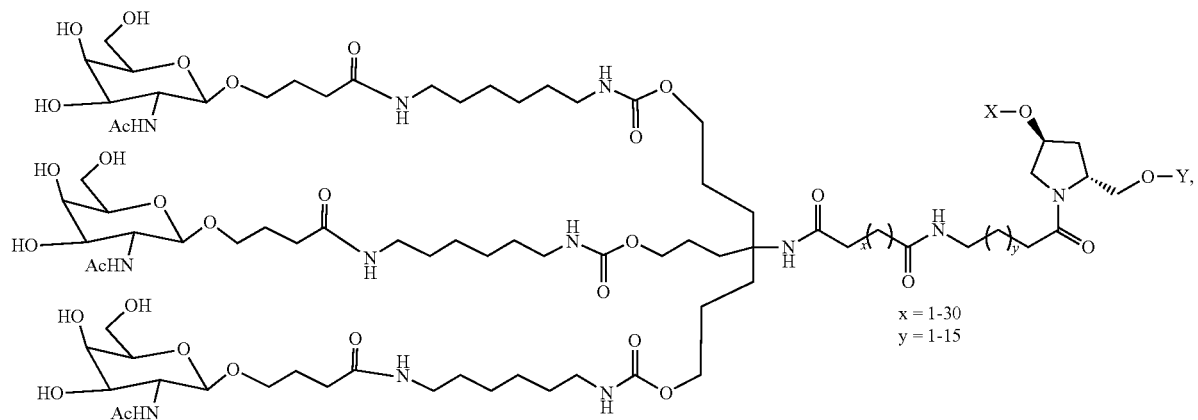
(Formula XXXIX)
x = 1-30
y = 1-15
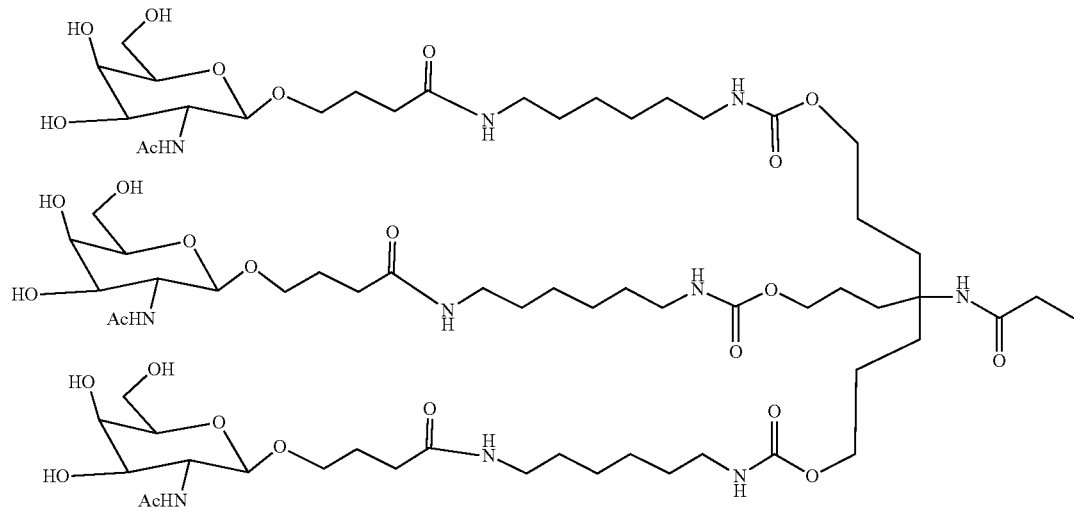
(Formula XL)

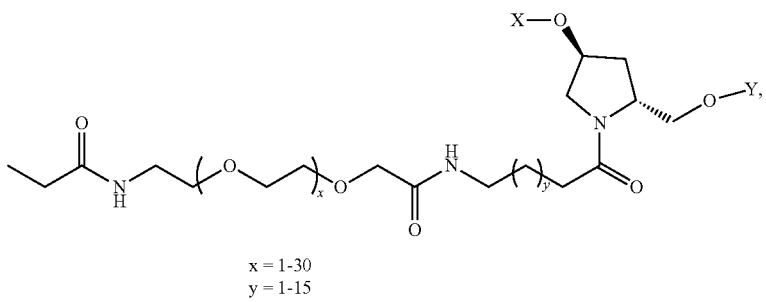
x = 1-30
y = 1-15
(Formula XLI)
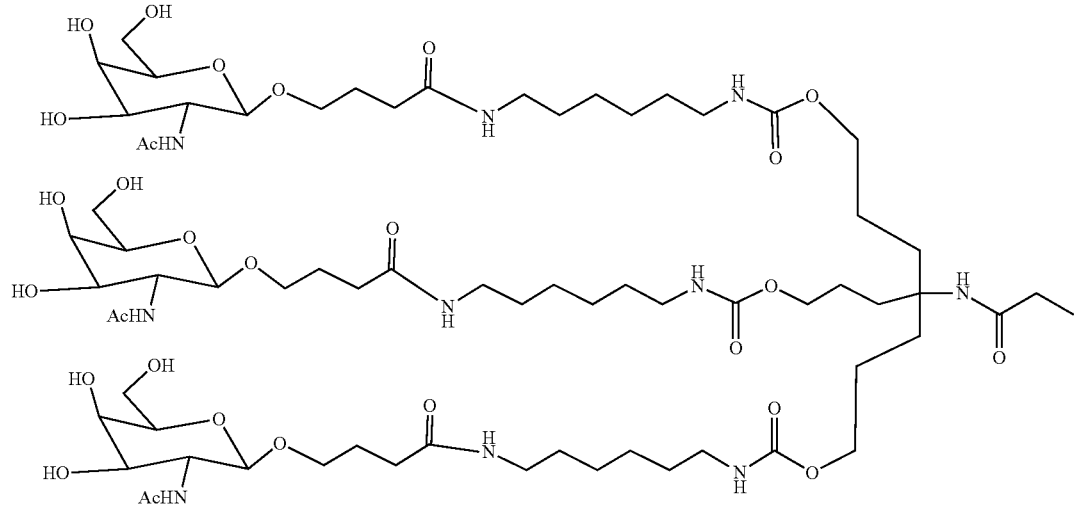
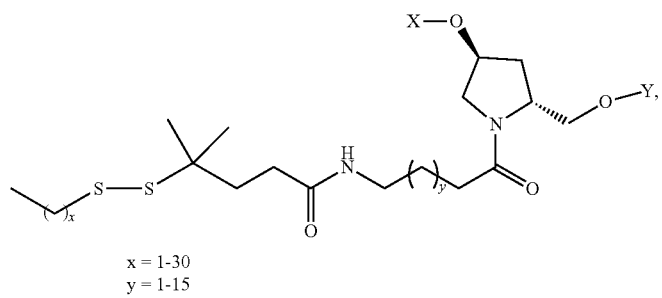
x = 1-30
y = 1-15
(Formula XLII)
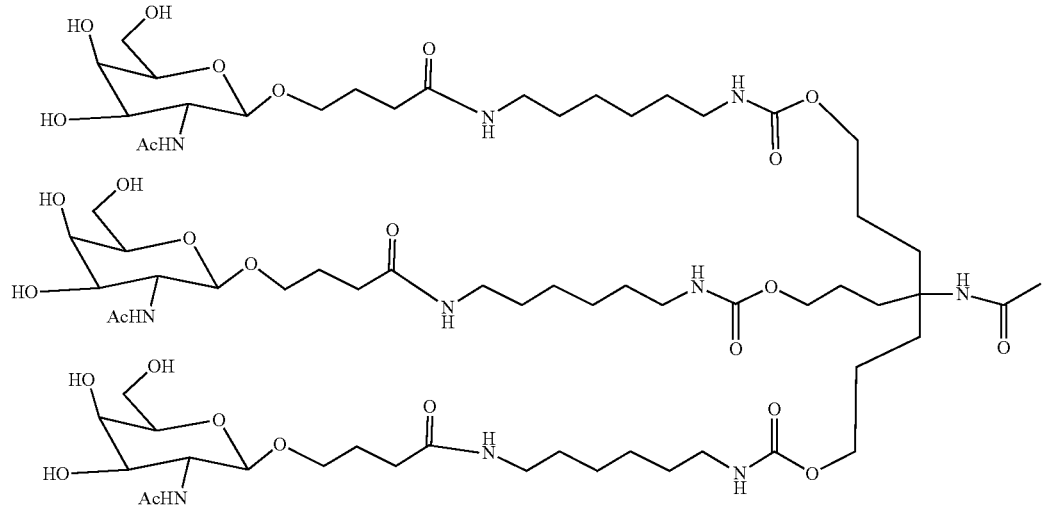

-continued
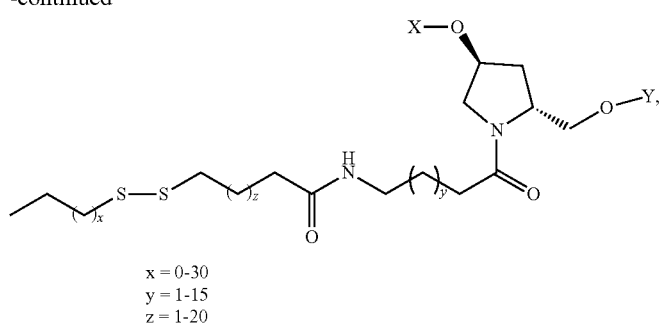
x = 0-30
y = 1-15
z = 1-20
(Formula XLIII)
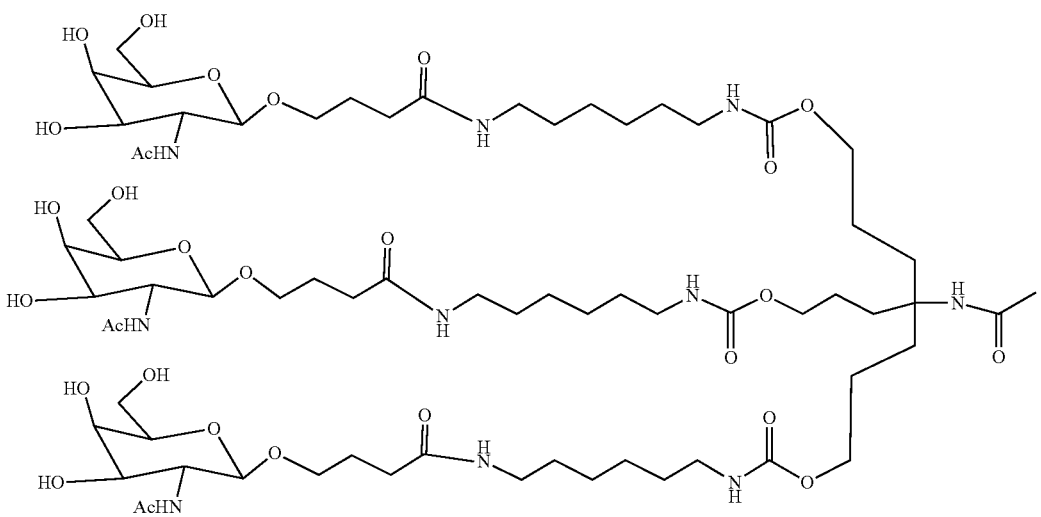
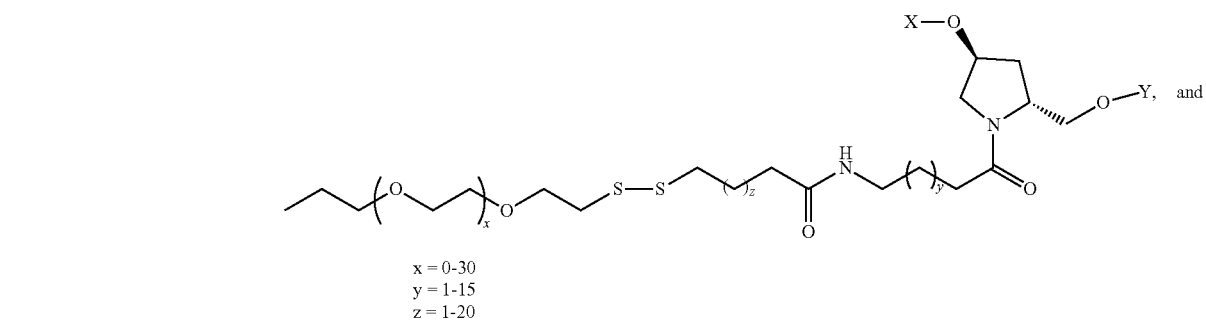
x = 0-30
y = 1-15
z = 1-20
and
(Formula XLIV)
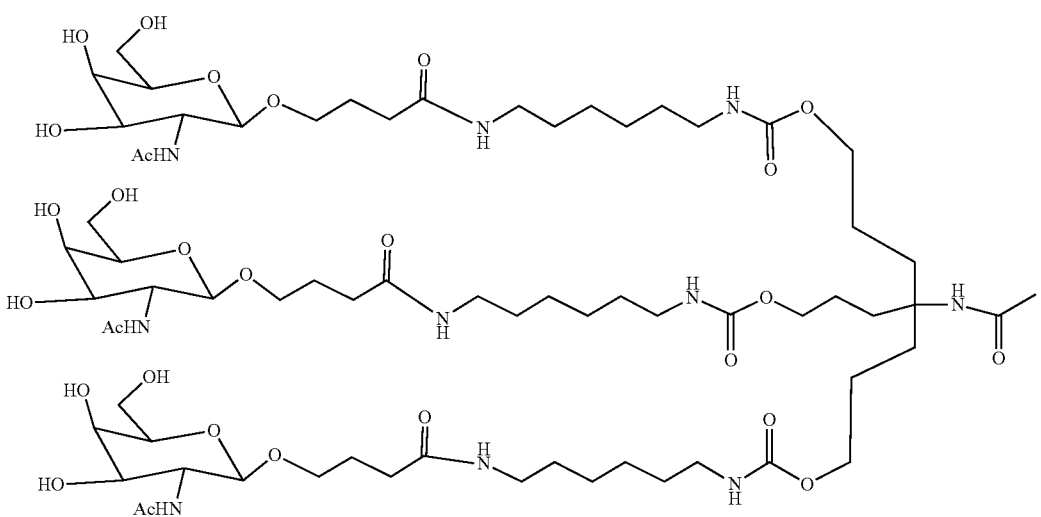

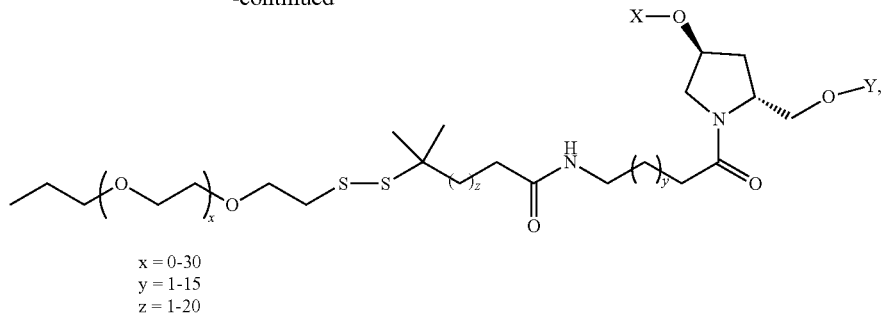

x = 0-30
y = 1-15
z = 1-20 when one of X or Y is an oligonucleotide, the other is a hydrogen.

In certain embodiments of the compositions and methods of the invention, a ligand is one or more GalNAc (N-acetyl-galactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVI):

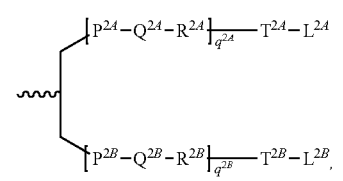

Formula XXXXV

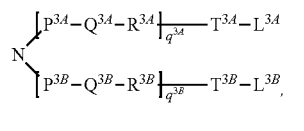

Formula XLVI

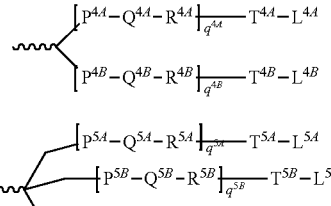

Formula XLVII

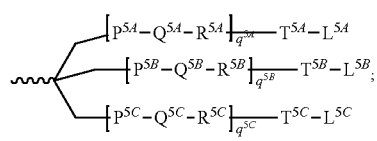

Formula XLVIII wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$, are each independently for each occurrence absent, CO, NH, O, S, OC(O), NHC(O), CH$_2$, CH$_2$NH or CH$_2$O;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R''), C≡C or C(O);
$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)—CH(R$^a$)—NH—, CO, CH=N—O,

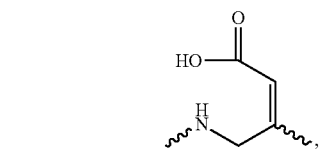

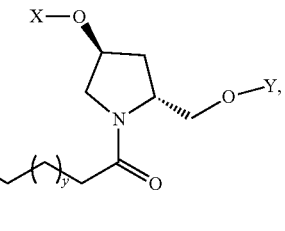

or heterocyclyl;
$L^{2A}$, $L^{2B}$, $L^{3A}$, $L^{3B}$, $L^{4A}$, $L^{4B}$ $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain. Trivalent conjugating GalNAc derivatives are particularly useful for use with RNAi agents for inhibiting the expression of a target gene, such as those of formula (XLIX):

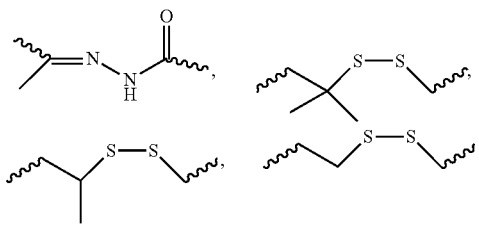

Formula XLIX wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541, 313; 5,545,730; 5,552,538; 5,578,717, 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject having a disorder of lipid metabolism) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L., (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J. et al., (2004) *Retina* 24:132-138) and subretinal injections in mice (Reich, S J. et al. (2003) *Mol. Vis.* 9:210-216) were both shown to prevent neovascularization in an experimental model of age-related macular degeneration. In addition, direct intratumoral injection of a dsRNA in mice reduces tumor volume (Pille, J. et al. (2005) *Mol. Ther.* 11:267-274) and can prolong survival of tumor-bearing mice (Kim, W J. et al., (2006) *Mol. Ther.* 14:343-350; Li, S. et al., (2007)*Mol. Ther.* 15:515-523). RNA interference has also shown success with local delivery to the CNS by direct injection (Dorn, G. et al., (2004) *Nucleic Acids* 32:e49; Tan, P H. et al. (2005) *Gene Ther.* 12:59-66; Makimura, H. et al. (2002) *BMC Neurosci.* 3:18; Shishkina, G T., et al. (2004) *Neuroscience* 129:521-528; Thakker, E R., et al. (2004) *Proc. Natl. Acad. Sci. U.S.A.* 101:17270-17275; Akaneya, Y., et al. (2005) *J. Neurophysiol.* 93:594-602) and to the lungs by intranasal administration (Howard, K A. et al., (2006) *Mol. Ther.* 14:476-484; Zhang, X. et al., (2004) *J. Biol. Chem.* 279:10677-10684; Bitko, V. et al., (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J. et al., (2004) *Nature* 432:173-178). Conjugation of an iRNA to an aptamer has been shown to inhibit tumor growth and mediate tumor regression in a mouse model of prostate cancer (McNamara, J O. et al., (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H. et al., (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al., (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector encoded iRNAs of the Invention iRNA targeting the HSD17B13 gene can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. Accordingly, in one embodiment, provided herein are pharmaceutical compositions comprising a double stranded ribonucleic acid (dsRNA) agent that inhibits expression of 17β-hydroxysteroid dehydrogenases type 13 (HSD17B13) in a cell, such as a liver cell, wherein the dsRNA agent comprises a sense strand and an antisense strand, wherein the sense strand comprises at least 15 contiguous nucleotides differing by no more than 1, 2, or 3 nucleotides from the nucleotide sequence of SEQ ID NO: 1, and said antisense strand comprises at least 15 contiguous nucleotides differing by no more than 1, 2, or 3 nucleotides from the nucleotide sequence of SEQ ID NO:7; and a pharmaceutically acceptable carrier. In some embodiments, the dsRNA agent comprises a sense strand and an antisense strand, wherein the sense strand comprises at least 15 contiguous nucleotides from the nucleotide sequence of SEQ ID NO:1, and said antisense strand comprises at least 15 contiguous nucleotides from the nucleotide sequence of SEQ ID NO:7.

In another embodiment, provided herein are pharmaceutical compositions comprising a dsRNA agent that inhibits expression of 17β-Hydroxysteroid dehydrogenases (HSD17B13) in a cell, such as a liver cell, wherein the dsRNA agent comprises a sense strand and an antisense strand, the antisense strand comprising a region of complementarity which comprises at least 15 contiguous nucleotides differing by no more than 1, 2, or 3 nucleotides from any one of the antisense sequences listed in any one of Tables 2, 3, 7, 8, 10, 11, or 13; and a pharmaceutically acceptable carrier. In some embodiments, the dsRNA agent comprises a sense strand and an antisense strand, the antisense strand comprising a region of complementarity which comprises at least 15 contiguous nucleotides from any one of the antisense sequences listed in any one of Tables 2, 3, 7, 8, 10, 11, or 13.

The pharmaceutical compositions containing the iRNA of the invention are useful for treating a disease or disorder associated with the expression or activity of an HSD17B13 gene, e.g., a chronic fibro-inflammatory disease.

Such pharmaceutical compositions are formulated based on the mode of delivery. One example is compositions that are formulated for systemic administration via parenteral delivery, e.g., by intravenous (IV), intramuscular (IM) or for subcutaneous delivery. Another example is compositions that are formulated for direct delivery into the liver, e.g., by infusion into the liver, such as by continuous pump infusion. The pharmaceutical compositions of the invention may be administered in dosages sufficient to inhibit expression of an HSD17B13 gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, preferably about 0.3 mg/kg and about 3.0 mg/kg. A repeat-dose regimen may include administration of a therapeutic amount of iRNA on a regular basis, such as every other day to once a year. In certain embodiments, the iRNA is administered about once per week, once every 7-10 days, once every 2 weeks, once every 3 weeks, once every 4 weeks, once every 5 weeks, once every 6 weeks, once every 7 weeks, once every 8 weeks, once every 9 weeks, once every 10 weeks, once every 11 weeks, once every 12 weeks, once per month, once every 2 months, once every 3 months (once per quarter), once every 4 months, once every 5 months, or once every 6 months.

After an initial treatment regimen, the treatments can be administered on a less frequent basis.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as an HSD17B13-associated disease, disorder, or condition that would benefit from reduction in the expression of HSD17B13. Such models can be used for in vivo testing of iRNA, as well as for determining a therapeutically effective dose. Such models can be used for in vivo testing of iRNA, as well as for determining a therapeutically effective dose. Suitable mouse models are known in the art and include, for example, mice and rats fed a high fat diet (HFD; also referred to as a Western diet), a methionine-choline deficient (MCD) diet, or a high-fat (15%), high-cholesterol (1%) diet (HFHC), an obese (ob/ob) mouse containing a mutation in the obese (ob) gene (Wiegman et al., (2003) *Diabetes,* 52:1081-1089); a mouse containing homozygous knock-out of an LDL receptor (LDLR −/− mouse; Ishibashi et al., (1993) *J Clin Invest* 92(2):883-893); diet-induced artherosclerosis mouse model (Ishida et al., (1991) *J. Lipid. Res.,* 32:559-568); heterozygous lipoprotein lipase knockout mouse model (Weistock et al., (1995) J. Clin. Invest. 96(6): 2555-2568); mice and rats fed a choline-deficient, L-amino acid-defined, high-fat diet (CDAHFD) (Matsumoto et al. (2013) *Int. J. Exp. Path.* 94:93-103); mice and rats fed a high-trans-fat, cholesterol diet (HTF-C) (Clapper et al. (2013) *Am. J. Physiol. Gastrointest. Liver Physiol.* 305: G483-G495); mice and rats fed a high-fat, high-cholesterol, bile salt diet (HF/HC/BS) (Matsuzawa et al. (2007) *Hepatology* 46:1392-1403); and mice and rats fed a high-fat diet+fructose (30%) water (Softic et al. (2018) *J. Clin. Invest.* 128(1)-85-96).

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular cell or tissue, such as the liver (e.g., the hepatocytes of the liver).

In some embodiments, the pharmaceutical compositions of the invention are suitable for intramuscular administration to a subject. In other embodiments, the pharmaceutical compositions of the invention are suitable for intravenous administration to a subject. In some embodiments of the invention, the pharmaceutical compositions of the invention are suitable for subcutaneous administration to a subject, e.g., using a 29 g or 30 g needle.

The pharmaceutical compositions of the invention may include an RNAi agent of the invention in an unbuffered solution, such as saline or water, or in a buffer solution, such as a buffer solution comprising acetate, citrate, prolamine, carbonate, or phosphate or any combination thereof.

In one embodiment, the pharmaceutical compositions of the invention, e.g., such as the compositions suitable for subcutaneous administration, comprise an RNAi agent of the invention in phosphate buffered saline (PBS). Suitable concentrations of PBS include, for example, 1 mM, 1.5 mM, 2 mM, 2.5 mM, 3 mM, 3.5 mM, 4 mM, 4.5 mM, 5 mM, 6.5 mM, 7 mM, 7.5.mM, 9 mM, 8.5 mM, 9 mM, 9.5 mM, or about 10 mM PBS. In one embodiment of the invention, a pharmaceutical composition of the invention comprises an RNAi agent of the invention dissolved in a solution of about 5 mM PBS (e.g., 0.64 mM NaH$_2$PO$_4$, 4.36 mM Na$_2$HPO$_4$, 85 mM NaCl). Values intermediate to the above recited ranges and values are also intended to be part of this invention. In addition, ranges of values using a combination of any of the above recited values as upper and/or lower limits are intended to be included.

The pH of the pharmaceutical compositions of the invention may be between about 5.0 to about 8.0, about 5.5 to about 8.0, about 6.0 to about 8.0, about 6.5 to about 8.0, about 7.0 to about 8.0, about 5.0 to about 7.5, about 5.5 to about 7.5, about 6.0 to about 7.5, about 6.5 to about 7.5, about 5.0 to about 7.2, about 5.25 to about 7.2, about 5.5 to about 7.2, about 5.75 to about 7.2, about 6.0 to about 7.2, about 6.5 to about 7.2, or about 6.8 to about 7.2. Ranges and values intermediate to the above recited ranges and values are also intended to be part of this invention.

The osmolality of the pharmaceutical compositions of the invention may be suitable for subcutaneous administration, such as no more than about 400 mOsm/kg, e.g., between 50 and 400 mOsm/kg, between 75 and 400 mOsm/kg, between 100 and 400 mOsm/kg, between 125 and 400 mOsm/kg, between 150 and 400 mOsm/kg, between 175 and 400 mOsm/kg, between 200 and 400 mOsm/kg, between 250 and 400 mOsm/kg, between 300 and 400 mOsm/kg, between 50 and 375 mOsm/kg, between 75 and 375 mOsm/kg, between 100 and 375 mOsm/kg, between 125 and 375 mOsm/kg, between 150 and 375 mOsm/kg, between 175 and 375 mOsm/kg, between 200 and 375 mOsm/kg, between 250 and 375 mOsm/kg, between 300 and 375 mOsm/kg, between 50 and 350 mOsm/kg, between 75 and 350 mOsm/kg, between 100 and 350 mOsm/kg, between 125 and 350 mOsm/kg, between 150 and 350 mOsm/kg, between 175 and 350 mOsm/kg, between 200 and 350 mOsm/kg, between 250 and 350 mOsm/kg, between 50 and 325 mOsm/kg, between 75 and 325 mOsm/kg, between 100 and 325 mOsm/kg, between 125 and 325 mOsm/kg, between 150 and 325 mOsm/kg, between 175 and 325 mOsm/kg, between 200 and 325 mOsm/kg, between 250 and 325 mOsm/kg, between 300 and 325 mOsm/kg, between 300 and 350 mOsm/kg, between 50 and 300 mOsm/kg, between 75 and 300 mOsm/kg, between 100 and 300 mOsm/kg, between 125 and 300 mOsm/kg, between 150 and 300 mOsm/kg, between 175 and 300 mOsm/kg, between 200 and 300 mOsm/kg, between 250 and 300, between 50 and 250 mOsm/kg, between 75 and 250 mOsm/kg, between 100 and 250 mOsm/kg, between 125 and 250 mOsm/kg, between 150 and 250 mOsm/kg, between 175 and 350 mOsm/kg, between 200 and 250 mOsm/kg, e.g., about 50, 55, 60, 65, 70, 75, 80, 85, 90, 95, 100, 105, 110, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 295, 300, 305, 310, 320, 325, 330, 335, 340, 345, 350, 355, 360, 365, 370, 375, 380, 385, 390, 395, or about 400 mOsm/kg. Ranges and values intermediate to the above recited ranges and values are also intended to be part of this invention.

The pharmaceutical compositions of the invention comprising the RNAi agents of the invention, may be present in a vial that contains about 0.5, 0.6, 0.7, 0.8, 0.9, 1.0, 1.1, 1.2, 1.3, 1.4, 1.5, 1.6, 1.7, 1.8, 1.9, or about 2.0 mL of the pharmaceutical composition. The concentration of the RNAi agents in the pharmaceutical compositions of the invention may be about 10, 15, 20, 25, 30, 35, 40, 45, 50, 55, 60, 65, 70, 75, 80, 85, 90, 95, 100, 105, 110, 115, 130, 125, 130, 135, 140, 145, 150, 175, 180, 185, 190, 195, 200, 205, 210, 215, 230, 225, 230, 235, 240, 245, 250, 275, 280, 285, 290, 295, 300, 305, 310, 315, 330, 325, 330, 335, 340, 345, 350, 375, 380, 385, 390, 395, 400, 405, 410, 415, 430, 425, 430, 435, 440, 445, 450, 475, 480, 485, 490, 495, or about 500 mg/mL. In one embodiment, the concentration of the RNAi agents in the pharmaceutical compositions of the invention is about 100 mg/mL. Values intermediate to the above recited ranges and values are also intended to be part of this invention.

The pharmaceutical compositions of the invention may comprise a dsRNA agent of the invention in a free acid form. In other embodiments of the invention, the pharmaceutical compositions of the invention may comprise a dsRNA agent of the invention in a salt form, such as a sodium salt form. In certain embodiments, when the dsRNA agents of the invention are in the sodium salt form, sodium ions are present in the agent as counterions for substantially all of the phosphodiester and/or phosphorothiotate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes include unilamellar or multilamellar vesicles which have a membrane formed from a lipophilic material and an aqueous interior. The aqueous portion contains the composition (e.g., iRNA) to be delivered. The lipophilic material isolates the aqueous interior from an aqueous exterior, which typically does not include the iRNA composition, although in some examples, it may. Cationic liposomes possess the advantage of being able to fuse to the cell wall. Non-cationic liposomes, although not able to fuse as efficiently with the cell wall, are taken up by macrophages in vivo.

In order to traverse intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis.

A liposome containing an iRNA agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The iRNA agent preparation is then added to the micelles that include the lipid component. The cationic groups on the lipid interact with the iRNA agent and condense around the iRNA agent to form a liposome. After condensation, the detergent is removed, e.g., by dialysis, to yield a liposomal preparation of iRNA agent.

If necessary a carrier compound that assists in condensation can be added during the condensation reaction, e.g., by controlled addition. For example, the carrier compound can be a polymer other than a nucleic acid (e.g., spermine or spermidine). pH can also be adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference.

Liposome formation can also include one or more aspects of exemplary methods described in Felgner, P. L. et al., Proc. Natl. Acad. Sci., USA 8:7413-7417, 1987; U.S. Pat. Nos. 4,897,355; 5,171,678; Bangham, et al. M. Mol. Biol. 23:238, 1965; Olson, et al. Biochim. Biophys. Acta 557:9, 1979; Szoka, et al. Proc. Natl. Acad. Sci. 75: 4194, 1978; Mayhew, et al. Biochim. Biophys. Acta 775:169, 1984; Kim, et al. Biochim. Biophys. Acta 728:339, 1983; and Fukunaga, et al. Endocrinol. 115:757, 1984. Commonly used techniques for preparing lipid aggregates of appropriate size for use as delivery vehicles include sonication and freeze-thaw plus extrusion (see, e.g., Mayer, et al. Biochim. Biophys. Acta 858:161, 1986). Microfluidization can be used when consistently small (50 to 200 nm) and relatively uniform aggregates are desired (Mayhew, et al. Biochim. Biophys. Acta 775:169, 1984). These methods are readily adapted to packaging iRNA agent preparations into liposomes.

Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185 and 5,171,678; WO 94/00569; WO 93/24640; WO 91/16024; Felgner, J. Biol. Chem. 269:2550, 1994; Nabel, Proc. Natl. Acad. Sci. 90:11307, 1993; Nabel, Human Gene Ther. 3:649, 1992; Gershon, Biochem. 32:7143, 1993; and Strauss EMBO J. 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P. *Pharma. Sci.*, 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters*, 1987, 223, 42; Wu et al., *Cancer Research*, 1993, 53, 3765).

Various liposomes comprising one or more glycolipids are known in the art. Papahadjopoulos et al. (*Ann. N. Y. Acad. Sci.*, 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In some embodiments, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver iRNA agents to macrophages.

Further advantages of liposomes include: liposomes obtained from natural phospholipids are biocompatible and biodegradable; liposomes can incorporate a wide range of water and lipid soluble drugs; liposomes can protect encapsulated iRNAs in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size, and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of iRNA agent (see, e.g., Felgner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ (Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis (oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer iRNA agent into the skin. In some implementations, liposomes are used for delivering iRNA agent to epidermal cells and also to enhance the penetration of iRNA agent into dermal tissues, e.g., into skin. For example, the liposomes can be applied topically. Topical delivery of drugs formulated as liposomes to the skin has been documented (see, e.g., Weiner et al., Journal of Drug Targeting, 1992, vol. 2,405-410 and du Plessis et al., Antiviral Research, 18, 1992, 259-265; Mannino, R. J. and Fould-Fogerite, S., Biotechniques 6:682-690, 1988; Itani, T. et al. Gene 56:267-276.1987; Nicolau, C. et al. Meth. Enz. 149:157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate cholesterol/polyoxyethylene-10-stearyl ether) were used to deliver a drug into the dermis of mouse skin. Such formulations with iRNA agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include iRNAs can be delivered, for example, subcutaneously by infection in order to deliver iRNAs to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transfersomes can be self-optimizing (adaptive to the shape of pores, e.g., in the skin), self-repairing, and can frequently reach their targets without fragmenting, and often self-loading.

Other formulations amenable to the present invention are described in WO 2008/042973.

Transfersomes are yet another type of liposomes and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in *Pharmaceutical Dosage Forms*, Marcel Dekker, Inc., New York, N.Y., 1988, p. 285).

If the surfactant molecule is not ionized, it is classified as a nonionic surfactant.

Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in *Pharmaceutical Dosage Forms*, Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of iRNA, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the RNAi and at least the alkali metal alkyl sulphate. The first micellar composition is then mixed with at least three micelle forming compounds to form a mixed micellar composition. In another method, the micellar composition is prepared by mixing the RNAi, the alkali metal alkyl sulphate and at least one of the micelle forming compounds, followed by addition of the remaining micelle forming compounds, with vigorous mixing.

Phenol or m-cresol may be added to the mixed micellar composition to stabilize the formulation and protect against bacterial growth. Alternatively, phenol or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNA agents of in the invention may be fully encapsulated in a lipid formulation, e.g., an LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). As used herein, the term "SPLP" refers to a nucleic acid-lipid particle comprising plasmid DNA encapsulated within a lipid vesicle. LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In certain embodiments, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid may be, for example, N,N-dioleyl-N,N-dimethylammonium chloride (DODAC), N,N-distearyl-N,N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino) ethyl)piperazin-1-yl)ethylazanediyl)didodecan-2-ol (Tech G1), or a mixture thereof. The cationic lipid may comprise from about 20 mol % to about 50 mol % or about 40 mol % of the total lipid present in the particle.

In certain embodiments, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In certain embodiments, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($C]_8$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

LNP01

In certain embodiments, the lipidoid ND98·4HCl (MW 1487) (see U.S. patent application Ser. No. 12/056,230, filed Mar. 26, 2008, which is herein incorporated by reference), Cholesterol (Sigma-Aldrich), and PEG-Ceramide C16 (Avanti Polar Lipids) can be used to prepare lipid-dsRNA nanoparticles (e.g., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

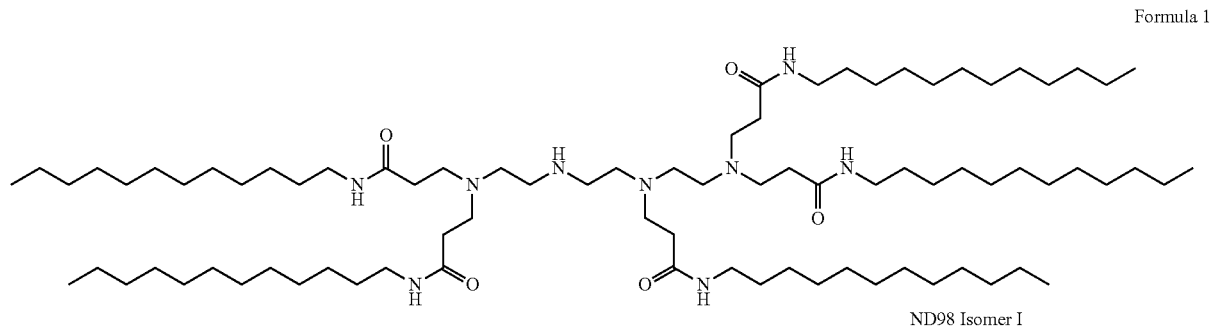 [SMILES: CCCCCCCCCCCCNC(=O)CCN(CCNCCN(CCC(=O)NCCCCCCCCCCCC)CCN(CCC(=O)NCCCCCCCCCCCC)CCC(=O)NCCCCCCCCCCCC)CCC(=O)NCCCCCCCCCCCC]

ND98 Isomer I

LNP01 formulations are described, e.g., in International Application Publication No. WO 2008/042973, which is hereby incorporated by reference.

Additional exemplary lipid-dsRNA formulations are provided in the following table.

TABLE A

| | | Exemplary lipid formulations | |
|---|---|---|---|
| | Cationic Lipid | cationic lipid/non-cationic lipid/cholesterol/PEG-lipid conjugate Lipid:siRNA ratio | |
| SNALP | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA~7:1 | |
| S-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA~7:1 | |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~6:1 | |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~11:1 | |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~6:1 | |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~11:1 | |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 | |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 | |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 | |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200) | C12-200/DSPC/Cholesterol/PEG-DMG 50/10/38.5/1.5 Lipid:siRNA 10:1 | |

TABLE A-continued

Exemplary lipid formulations

| | Cationic Lipid | cationic lipid/non-cationic lipid/cholesterol/PEG-lipid conjugate<br>Lipid:siRNA ratio |
|---|---|---|
| LNP13 | XTC | XTC/DSPC/Chol/PEG-DMG<br>50/10/38.5/1.5<br>Lipid:siRNA: 33:1 |
| LNP14 | MC3 | MC3/DSPC/Chol/PEG-DMG<br>40/15/40/5<br>Lipid:siRNA: 11:1 |
| LNP15 | MC3 | MC3/DSPC/Chol/PEG-DSG/GalNAc-PEG-DSG<br>50/10/35/4.5/0.5<br>Lipid:siRNA: 11:1 |
| LNP16 | MC3 | MC3/DSPC/Chol/PEG-DMG<br>50/10/38.5/1.5<br>Lipid:siRNA: 7:1 |
| LNP17 | MC3 | MC3/DSPC/Chol/PEG-DSG<br>50/10/38.5/1.5<br>Lipid:siRNA: 10:1 |
| LNP18 | MC3 | MC3/DSPC/Chol/PEG-DMG<br>50/10/38.5/1.5<br>Lipid:siRNA: 12:1 |
| LNP19 | MC3 | MC3/DSPC/Chol/PEG-DMG<br>50/10/35/5<br>Lipid:siRNA: 8:1 |
| LNP20 | MC3 | MC3/DSPC/Chol/PEG-DPG<br>50/10/38.5/1.5<br>Lipid:siRNA: 10:1 |
| LNP21 | C12-200 | C12-200/DSPC/Chol/PEG-DSG<br>50/10/38.5/1.5<br>Lipid:siRNA: 7:1 |
| LNP22 | XTC | XTC/DSPC/Chol/PEG-DSG<br>50/10/38.5/1.5<br>Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Ser. No. 61/185,712, filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Provisional Ser. No. 61/244,834, filed Sep. 22, 2009, U.S. Provisional Ser. No. 61/185,800, filed Jun. 10, 2009, and International Application No. PCT/US10/28224, filed Jun. 10, 2010, which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cat-ionized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publication. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.). Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes.

WO 97/04787 to Love et al. discloses liposomes comprising dsRNAs targeted to the raf gene.

C. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invitrogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more agents which function by a non-RNAi mechanism and which are useful in treating an HSD17B13-associated disease, disorder, or condition. Examples of such agents include, but are not limited to pyridoxine, an ACE inhibitor (angiotensin converting enzyme inhibitors), e.g., benazepril (Lotensin); an angiotensin II receptor antagonist (ARB) (e.g., losartan potassium, such as Merck & Co.'s Cozaar®), e.g., Candesartan (Atacand); an HMG-CoA reductase inhibitor (e.g., a statin); calcium binding agents, e.g., Sodium cellulose phosphate (Calcibind); diuretics, e.g., thiazide diuretics, such as hydrochlorothiazide (Microzide); an insulin sensitizer, such as the PPARγ agonist pioglitazone, a glp-1r agonist, such as liraglutatide, vitamin E, an SGLT2 inhibitor, a DPPIV inhibitor, and kidney/liver transplant; or a combination of any of the foregoing.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the $ED_{50}$ with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by HSD17B13 expression. In any event, the administering physician can adjust the amount and timing of iRNA administration on the basis of results observed using standard measures of efficacy known in the art or described herein.

Synthesis of Cationic Lipids:

Any of the compounds, e.g., cationic lipids and the like, used in the nucleic acid-lipid particles featured in the invention may be prepared by known organic synthesis techniques. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms may be optionally oxidized, and the nitrogen heteroatom may be optionally quaternized, including bicyclic rings in which any of the above heterocycles are fused to a benzene ring. The heterocycle may be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —OR$^x$, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$NR$^x$R$^y$, wherein n is 0, 1 or 2, R$^x$ and R$^y$ are the same or different and independently hydrogen, alkyl or heterocycle, and each of said alkyl and heterocycle substituents may be further substituted with one or more of oxo, halogen, —OH, —CN, alkyl, —OR$^x$, heterocycle, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$-NR$^x$R$^y$.

"Halogen" means fluoro, chloro, bromo and iodo.

In some embodiments, the methods featured in the invention may require the use of protecting groups. Protecting group methodology is well known to those skilled in the art (see, for example, PROTECTIVE GROUPS IN ORGANIC SYNTHESIS, Green, T. W. et al., Wiley-Interscience, New York City, 1999). Briefly, protecting groups within the context of this invention are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A:

In certain embodiments, nucleic acid-lipid particles featured in the invention are formulated using a cationic lipid of formula A:

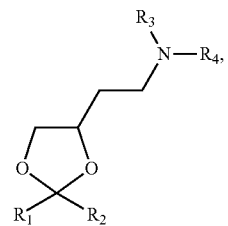

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl-[1,3]-dioxolane). In general, the lipid of formula A above may be made by the following Reaction Schemes 1 or 2, wherein all substituents are as defined above unless indicated otherwise.

Scheme 1

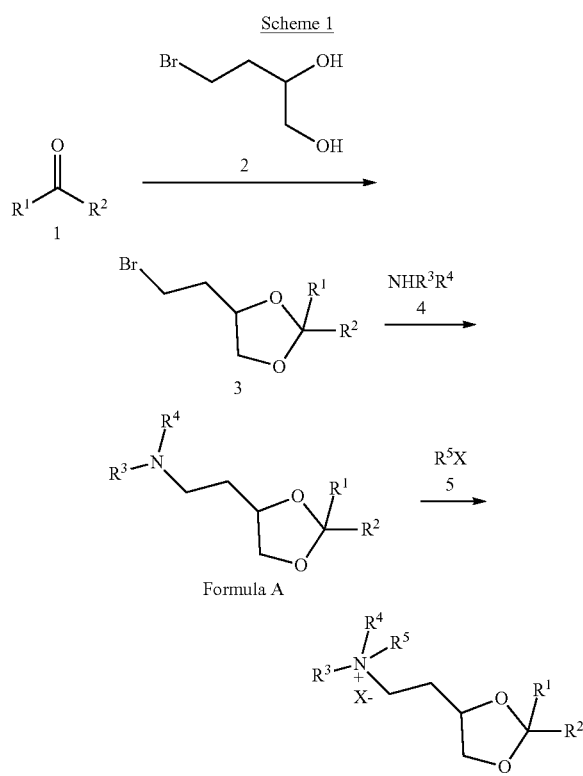

Lipid A, where $R_1$ and $R_2$ are independently alkyl, alkenyl or alkynyl, each can be optionally substituted, and $R_3$ and $R_4$ are independently lower alkyl or $R_3$ and $R_4$ can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

Scheme 2

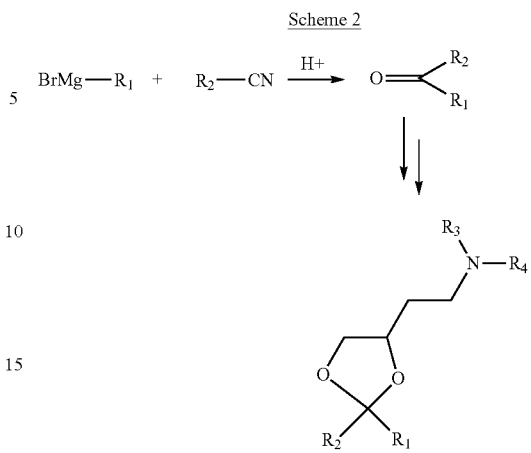

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3:

Preparation of DLin-M-C3-DMA (i.e., (6Z,9Z,28Z,31Z)-heptatriaconta-6,9,28,31-tetraen-19-yl 4-(dimethylamino)butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g).

Synthesis of ALNY-100:

Synthesis of ketal 519 [ALNY-100] was performed using the following scheme 3:

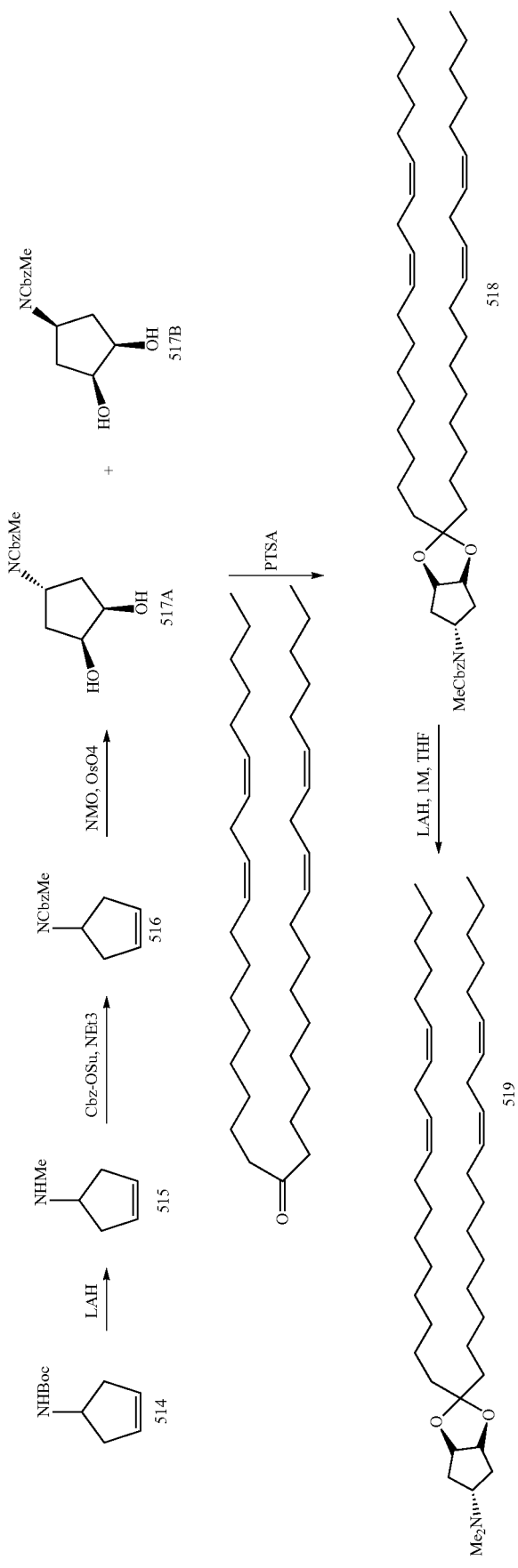

Synthesis of 515:

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0° C. under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516:

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated NaHCO3 solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H]-232.3 (96.94%).

Synthesis of 517A and 517B:

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated NaHCO3(1×50 mL) solution, water (1×30 mL) and finally with brine (1×50 mL). Organic phase was dried over $Na_2SO_4$ and solvent was removed in vacuum. Silica gel column chromatographic purification of the crude material was afforded a mixture of diastereomers, which were separated by prep HPLC. Yield: ~6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS—[M+H]–266.3, [M+NH4+]–283.5 present, HPLC-97.86%. Stereochemistry confirmed by X-ray.

Synthesis of 518:

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519:

A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous $Na_2SO_4$ then filtered through Celite® and reduced to an oil. Column chromatography provided the pure 519 (1.3 g, 68%) which was obtained as a colorless oil. 13C NMR=130.2, 130.1 (×2), 127.9 (×3), 112.3, 79.3, 64.4, 44.7, 38.3, 35.4, 31.5, 29.9 (×2), 29.7, 29.6 (×2), 29.5 (×3), 29.3 (×2), 27.2 (×3), 25.6, 24.5, 23.3, 226, 14.1; Electrospray MS (+ve): Molecular weight for C44H80NO2 (M+H)+ Calc. 654.6, Found 654.6.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as RiboGreen® (Molecular Probes) in the presence or absence of a formulation disrupting surfactant, e.g., 0.5% Triton-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

VI. Methods of the Invention

The present invention also provides methods of using an iRNA of the invention and/or a composition of the invention to reduce and/or inhibit HSD17B13 expression in a cell, such as a cell in a subject, e.g., a hepatocyte. The methods include contacting the cell with an RNAi agent or pharmaceutical composition comprising an iRNA agent of the invention. In some embodiments, the cell is maintained for a time sufficient to obtain degradation of the mRNA transcript of an HSD17B13 gene.

The present invention also provides methods of using an iRNA of the invention and/or a composition of the invention and an iRNA agent targeting a Patatin-like Phospholipase Domain Containing 3 (PNPLA3) gene and/or pharmaceutical composition comprising an iRNA agent targeting PNPLA3 to reduce and/or inhibit HSD17B13 expression in a cell, such as a cell in a subject, e.g., a hepatocyte.

In addition, the present invention provides methods of inhibiting the accumulation and/or expansion of lipid droplets in a cell, such as a cell in a subject, e.g., a hepatocyte. The methods include contacting the cell with an RNAi agent or pharmaceutical composition comprising an iRNA agent of the invention and an iRNA agent targeting a PNPLA3 gene and/or pharmaceutical composition comprising an iRNA agent targeting PNPLA3. In some embodiments, the cell is maintained for a time sufficient to obtain degradation of the mRNA transcript of an HSD17B13 gene and a PNPLA3 gene.

Reduction in gene expression can be assessed by any methods known in the art. For example, a reduction in the expression of HSD17B13 may be determined by determining the mRNA expression level of HSD17B13 using methods routine to one of ordinary skill in the art, e.g., Northern blotting, qRT-PCR; by determining the protein level of HSD17B13 using methods routine to one of ordinary skill in the art, such as Western blotting, immunological techniques. A reduction in the expression of HSD17B13 may also be assessed indirectly by measuring a decrease in biological activity of HSD17B13, e.g., a decrease in the enzymatic activity of HSD17B13 and/or a decrease in one or more of a lipid, a triglyceride, cholesterol (including LDL-C, HDL-C, VLDL-C, IDL-C and total cholesterol), or free fatty acids in a plasma, or a tissue sample, and/or a reduction in accumulation of fat and/or expansion of lipid droplets in the liver.

Suitable agents targeting a PNPLA3 gene are described in, for example, U.S. Patent Publication No.: 2017/0340661, the entire contents of which are incorporated herein by reference.

In the methods of the invention the cell may be contacted in vitro or in vivo, i.e., the cell may be within a subject.

A cell suitable for treatment using the methods of the invention may be any cell that expresses an HSD17B13 gene (and, in some embodiments, a PNPLA3 gene). A cell suitable for use in the methods of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell, e.g., a human liver cell.

HSD17B13 expression is inhibited in the cell by at least about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or about 100%. In preferred embodiments, HSD17B13 expression is inhibited by at least 20%.

In some embodiment, PNPLA3 expression is also inhibited in the cell by at least about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or about 100%. In preferred embodiments, PNPLA3 expression is inhibited by at least 20%.

In one embodiment, the in vivo methods of the invention may include administering to a subject a composition containing an iRNA, where the iRNA includes a nucleotide sequence that is complementary to at least a part of an RNA transcript of the HSD17B13 gene of the mammal to be treated.

In another embodiment, the in vivo methods of the invention may include administering to a subject a composition containing a first iRNA agent and a second iRNA agent, where the first iRNA includes a nucleotide sequence that is complementary to at least a part of an RNA transcript of the HSD17B13 gene of the mammal to be treated and and the second iRNA includes a nucleotide sequence that is complementary to at least a part of an RNA transcript of the PNPLA3 gene of the mammal to be treated.

When the organism to be treated is a mammal such as a human, the composition can be administered by any means known in the art including, but not limited to oral, intraperitoneal, or parenteral routes, including intracranial (e.g., intraventricular, intraparenchymal and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of HSD17B13, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the liver.

An iRNA of the invention may be present in a pharmaceutical composition, such as in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

The mode of administration may be chosen based upon whether local or systemic treatment is desired and based upon the area to be treated. The route and site of administration may be chosen to enhance targeting.

In one aspect, the present invention also provides methods for inhibiting the expression of an HSD17B13 gene in a mammal. The methods include administering to the mammal a composition comprising a dsRNA that targets an HSD17B13 gene in a cell of the mammal, thereby inhibiting expression of the HSD17B13 gene in the cell.

In some embodiment, the methods include administering to the mammal a composition comprising a dsRNA that targets an HSD17B13 gene in a cell of the mammal, thereby inhibiting expression of the HSD17B13 gene in the cell. In another embodiment, the methods include administering to the mammal a pharmaceutical composition comprising a dsRNA agent that targets an HSD17B13 gene in a cell of the mammal.

In another aspect, the present invention provides use of an iRNA agent or a pharmaceutical composition of the invention for inhibiting the expression of an HSD17B13 gene in a mammal.

In yet another aspect, the present invention provides use of an iRNA agent of the invention targeting a HSD17B13gene or a pharmaceutical composition comprising such an agent in the manufacture of a medicament for inhibiting expression of a HSD17B13 gene in a mammal.

In another aspect, the present invention also provides methods for inhibiting the expression of an HSD17B13 gene and a PNPLA3 gene in a mammal. The methods include administering to the mammal a composition comprising a dsRNA that targets an HSD17B13 gene in a cell of the mammal and a composition comprising a dsRNA that targets an PNPLA3 gene in a cell of the mammal, thereby inhibiting expression of the HSD17B13 gene and the PNPLA3 gene in the cell. In one embodiment, the methods include administering to the mammal a pharmaceutical composition comprising a dsRNA agent that targets an HSD17B13 gene and a PNPLA3 gene in a cell of the mammal.

In one aspect, the present invention provides use of an iRNA agent or a pharmaceutical composition of the invention, and a dsRNA that targets a PNPLA3 gene or a pharmaceutical composition comprising such an agent for inhibiting the expression of an HSD17B13 gene and a PNPLA3 gene in a mammal.

In yet another aspect, the present invention provides use of an iRNA agent of the invention targeting a HSD17B13gene or a pharmaceutical composition comprising such an agent, and a dsRNA that targets an PNPLA3 gene or a pharmaceutical composition comprising such an agent in the manufacture of a medicament for inhibiting expression of a HSD17B13 gene and a PNPLA3 gene in a mammal.

Reduction in gene expression can be assessed by any methods known it the art and by methods, e.g. qRT-PCR, described herein. Reduction in protein production can be assessed by any methods known it the art and by methods, e.g. ELISA, enzymatic activity, described herein.

The present invention also provides therapeutic and prophylactic methods which include administering to a subject having, or prone to developing a fatty liver-associated disease, disorder, or condition, the iRNA agents, pharmaceutical compositions comprising an iRNA agent, or vectors comprising an iRNA of the invention.

In one aspect, the present invention provides methods of treating a subject having a disorder that would benefit from reduction in HSD17B13 expression, e.g., an HSD17B13-associated disease.

The treatment methods (and uses) of the invention include administering to the subject, e.g., a human, a therapeutically effective amount of a dsRNA agent that inhibits expression of HSD17B13 or a pharmaceutical composition comprising a dsRNA that inhibits expression of HSD17B13, thereby treating the subject.

In one aspect, the invention provides methods of preventing at least one symptom in a subject having a disorder that would benefit from reduction in HSD17B13 expression, e.g., a chronic fibro-inflammatory disease. The methods include administering to the subject a prophylactically effective amount of dsRNA agent or a pharmaceutical composition comprising a dsRNA, thereby preventing at least one symptom in the subject.

In one embodiment, an HSD17B13-associated disease, disorder, or condition is a chronic fibro-inflammatory liver disease. Non-limiting examples of chronic fibro-inflammatory liver diseases include cancer, e.g., cancer, e.g., hepatocellular carcinoma, nonalcoholic steatohepatitis (NASH), cirrhosis of the liver, inflammation of the liver, hepatocellular necrosis, liver fibrosis, and nonalcoholic fatty liver disease (NAFLD).

The present invention also provides therapeutic and prophylactic methods which include administering to a subject having, or prone to developing a fatty liver-associated disease, disorder, or condition, the iRNA agents, pharmaceutical compositions comprising an iRNA agent, or vectors comprising an iRNA of the invention and and iRNA agent targeting PNPLA3, pharmaceutical compositions comprising such an iRNA agent, or vectors comprising such an iRNA.

The present invention also provides use of a therapeutically effective amount of an iRNA agent of the invention or a pharmaceutical composition comprising a dsRNA that inhibits expression of HSD17B13 for treating a subject, e.g., a subject that would benefit from a reduction and/or inhibition of HSD17B13 expression, e.g., an HSD17B13-associated disease, e.g., a chronic fibro-inflammatory disease.

In another aspect, the present invention provides use of an iRNA agent, e.g., a dsRNA, of the invention targeting a HSD17B13 for gene or a pharmaceutical composition comprising an iRNA agent targeting a HSD17B13 for gene in the manufacture of a medicament for treating a subject, e.g., a subject that would benefit from a reduction and/or inhibition of HSD17B13 for expression, e.g., a HSD17B13-associated disease.

The present invention also provides use of a prophylactically effective amount of an iRNA agent of the invention or a pharmaceutical composition comprising a dsRNA that inhibits expression of HSD17B13 for preventing at least one symptom in a subject having a disorder that would benefit from reduction in HSD17B13 expression, e.g., a chronic fibro-inflammatory disease.

In another aspect, the present invention provides use of an iRNA agent, e.g., a dsRNA, of the invention targeting a HSD17B13 gene or a pharmaceutical composition comprising an iRNA agent targeting a HSD17B13 gene in the manufacture of a medicament for preventing at least one symptom in a subject having a disorder that would benefit from reduction in HSD17B13 expression, e.g., a chronic fibro-inflammatory disease.

In one aspect, the present invention also provides use of a therapeutically effective amount of an iRNA agent of the invention or a pharmaceutical composition comprising a dsRNA that inhibits expression of HSD17B13 in combination with a dsRNA that targets a PNPLA3 gene or a pharmaceutical composition comprising such an agent for treating a subject, e.g., a subject that would benefit from a reduction and/or inhibition of HSD17B13 expression, e.g., an HSD17B13-associated disease, e.g., a chronic fibro-inflammatory disease.

In one aspect, the present invention also provides use of an iRNA agent, e.g., a dsRNA, of the invention targeting a HSD17B13 gene or a pharmaceutical composition comprising an iRNA agent targeting a HSD17B13 gene in combination with a dsRNA that targets a PNPLA3 gene or a pharmaceutical composition comprising such an agent for preventing at least one symptom in a subject having a disorder that would benefit from reduction in HSD17B13 expression, e.g., a chronic fibro-inflammatory disease.

The combination methods of the invention for treating a subject, e.g., a human subject, having a HSD17B13-associated disease, disorder, or condition, such as a chronic fibro-inflammatory liver disease, e.g., NASH, are useful for treating such subjects as silencing of PNPLA3 decreases steatosis (i.e. liver fat) while silencing HSD17B13 decreases inflammation and fibrosis. For example, genome wide association studies have demonstrated that silencing PNPLA3 and HSD17B13 have an additive effect to decrease NASH pathology. Indeed, a protective loss-of-function HSD17B13 allele was found to be associated with lower prevalence of NASH in subjects with pathogenic PNPLA3 alleles. In subjects having wild-type PNPLA3 alleles which have lower risk of NASH, the added presence of loss-of-function HSD17B13 alleles conferred even greater protection.

Accordingly, in one aspect, the present invention provides methods of treating a subject having a disorder that would benefit from reduction in HSD17B13 expression, e.g., an HSD17B13-associated disease, such as a chronic fibro-inflammatory liver disease (e.g., cancer, e.g., hepatocellular carcinoma, nonalcoholic steatohepatitis (NASH), cirrhosis of the liver, inflammation of the liver, hepatocellular necrosis, liver fibrosis, and nonalcoholic fatty liver disease (NAFLD). In one embodiment, the chronic fibro-inflammatory liver disease is NASH.

The combination treatment methods (and uses) of the invention include administering to the subject, e.g., a human subject, a therapeutically effective amount of a dsRNA agent that inhibits expression of HSD17B13 or a pharmaceutical composition comprising a dsRNA that inhibits expression of HSD17B13, and a dsRNA agent that inhibits expression of PNPLA3 or a pharmaceutical composition comprising a dsRNA that inhibits expression of PNPLA3, thereby treating the subject.

In one aspect, the invention provides methods of preventing at least one symptom in a subject having a disorder that would benefit from reduction in HSD17B13 expression, e.g., a chronic fibro-inflammatory disease, e.g., NASH. The methods include administering to the subject a prophylactically effective amount of dsRNA agent or a pharmaceutical composition comprising a dsRNA that inhibits expression of HSD17B13, and a dsRNA agent that inhibits expression of PNPLA3 or a pharmaceutical composition comprising a dsRNA that inhibits expression of PNPLA3, thereby preventing at least one symptom in the subject.

In one embodiment, the subject is heterozygous for the gene encoding the patatin like phospholipase domain containing 3 (PNPLA3) I148M variation. In another embodiment, the subject is homozygous for the gene encoding the PNPLA3 I148M variation. In one embodiment, the subject is heterozygous for the gene encoding the patatin like phospholipase domain containing 3 (PNPLA3) I144M variation. In another embodiment, the subject is homozygous for the gene encoding the PNPLA3 I144M variation. In one embodiment, the subject is homozygous for the gene encoding a functional HSD17B13 protein. In another embodiment, the subject is heterozygous for the gene encoding a functional HSD17B13 protein. In yet another embodiment, the subject is heterozygous for the gene encoding a functional HSD17B13 protein and a gene encoding a loss of function variant of HSD17B13. In another embodiment, the subject is not a carrier of the HSD17B13 rs72613567 variant.

In certain embodiments of the invention the methods may include identifying a subject that would benefit from reduction in HSD17B13 expression. The methods generally include determining whether or not a sample from the subject comprises a nucleic acid encoding a PNPLA3Ile148Met variant or a PNPLA3Ile144Met variant. The methods may also include classifying a subject as a candidate for treating or inhibiting a liver disease by inhibiting the expression of aHSD17B13, by determining whether or not a sample from the subject comprises a first nucleic acid encoding a PNPLA3 protein comprising an I148M variation and a second nucleic acid encoding a functional HSD17B13 protein, and/or a PNPLA3 protein comprising an I148M variation and a functional HSD17B13 protein, and classifying the subject as a candidate for treating or inhibiting a liver disease by inhibiting HSD17B13 when both the first and second nucleic acids are detected and/or when both proteins are detected.

The variant PNPLA3 Ile148Met variant or PNPLA3 Ile144Met variant can be any of the PNPLA3 Ile148Met variants and PNPLA3 Ile144Met variants described herein. The PNPLA3 Ile148Met variant or PNPLA3 Ile144Met variant can be detected by any suitable means, such as ELISA assay, RT-PCR, sequencing.

In some embodiments, the methods further comprise determining whether the subject is homozygous or heterozygous for the PNPLA3 Ile148Met variant or the PNPLA3 Ile144Met variant. In some embodiments, the subject is homozygous for the PNPLA3 Ile148Met variant or the PNPLA3 Ile144Met variant. In some embodiments, the subject is heterozygous for the PNPLA3 Ile148Met variant or the PNPLA3 Ile144Met variant. In some embodiments, the subject is homozygous for the PNPLA3 Ile148Met variant. In some embodiments, the subject is heterozygous for the PNPLA3 Ile148Met variant. In some embodiments, the subject is homozygous for the PNPLA3 Ile144Met variant. In some embodiments, the subject is heterozygous for the PNPLA3 Ile144Met variant.

In some embodiments, the subject does not comprise any genes encoding loss of function variations in the HSD17B13 protein. It is believed that loss of function variations in the HSD17B13 protein, including those described herein and in U.S. Provisional Application Ser. No. 62/570,985, filed on Oct. 11, 2017, confer a liver disease-protective effect and it is further believed that this protective effect is enhanced in the presence of the variant PNPLA3 Ile148M variation.

In some embodiments, the methods further comprise determining whether the subject is obese. In some embodiments, a subject is obese if their body mass index (BMI) is over 30 kg/m$^2$. Obesity can be a characteristic of a subject having, or at risk of developing, a liver disease. In some embodiments, the methods further comprise determining whether the subject has a fatty liver. A fatty liver can be a characteristic of a subject having, or at risk of developing, a liver disease. In some embodiments, the methods further comprise determining whether the subject is obese and has a fatty liver.

As used herein, "nonalcoholic fatty liver disease," used interchangeably with the term "NAFLD," refers to a disease defined by the presence of macrovascular steatosis in the presence of less than 20 gm of alcohol ingestion per day. NAFLD is the most common liver disease in the United States, and is commonly associated with insulin resistance/type 2 diabetes mellitus and obesity. NAFLD is manifested by steatosis, steatohepatitis, cirrhosis, and sometimes hepatocellaular carcinoma. For a review of NAFLD, see Tolman and Dalpiaz (2007) Ther. Clin. Risk. Manag., 3(6):1153-1163 the entire contents of which are incorporated herein by reference.

As used herein, the terms "steatosis," "hepatic steatosis," and "fatty liver disease" refer to the accumulation of triglycerides and other fats in the liver cells.

As used herein, the term "Nonalcoholic steatohepatitis" or "NASH" refers to liver inflammation and damage caused by a buildup of fat in the liver. NASH is part of a group of conditions called nonalcoholic fatty liver disease (NAFLD). NASH resembles alcoholic liver disease, but occurs in people who drink little or no alcohol. The major feature in NASH is fat in the liver, along with inflammation and damage. Most people with NASH feel well and are not aware that they have a liver problem. Nevertheless, NASH can be severe and can lead to cirrhosis, in which the liver is permanently damaged and scarred and no longer able to work properly. NASH is usually first suspected in a person who is found to have elevations in liver tests that are included in routine blood test panels, such as alanine aminotransferase (ALT) or aspartate aminotransferase (AST). When further evaluation shows no apparent reason for liver disease (such as medications, viral hepatitis, or excessive use of alcohol) and when x rays or imaging studies of the liver show fat, NASH is suspected. The only means of proving a diagnosis of NASH and separating it from simple fatty liver is a liver biopsy.

As used herein, the term "cirrhosis," defined histologically, is a diffuse hepatic process characterized by fibrosis and conversion of the normal liver architecture into structurally abnormal nodules.

As used herein, the term "serum lipid" refers to any major lipid present in the blood. Serum lipids may be present in the blood either in free form or as a part of a protein complex, e.g., a lipoprotein complex. Non-limiting examples of serum lipids may include triglycerides (TG), cholesterol, such as total cholesterol (TC), low density lipoprotein cholesterol (LDL-C), high-density lipoprotein cholesterol (HDL-C), very low density lipoprotein cholesterol (VLDL-C) and intermediate-density lipoprotein cholesterol (IDL-C).

In one embodiment, a subject that would benefit from the reduction of the expression of HSD17B13 (and, in some embodiments, PNPLA3) is, for example, a subject that has type 2 diabetes and prediabetes, or obesity; a subject that has high levels of fats in the blood, such as cholesterol, or has high blood pressure; a subject that has certain metabolic disorders, including metabolic syndrome; a subject that has rapid weight loss; a subject that has certain infections, such as hepatitis C infection, or a subject that has been exposed to some toxins. In one embodiment, a subject that would benefit from the reduction of the expression of HSD17B13 (and, in some embodiments, PNPLA3) is, for example, a subject that is middle-aged or older; a subject that is Hispanic, non-Hispanic whites, or African Americans; a subject that takes certain drugs, such as corticosteroids and cancer drugs.

In the methods (and uses) of the invention which comprise administering to a subject a first dsRNA agent targeting HSD17B13 and a second dsRNA agent targeting PNPLA3, the first and second dsRNA agents may be formulated in the same composition or different compositions and may administered to the subject in the same composition or in separate compositions.

In one embodiment, an "iRNA" for use in the methods of the invention is a "dual targeting RNAi agent." The term "dual targeting RNAi agent" refers to a molecule comprising a first dsRNA agent comprising a complex of ribonucleic acid molecules, having a duplex structure comprising two anti-parallel and substantially complementary nucleic acid strands, referred to as having "sense" and "antisense" orientations with respect to a first target RNA, i.e., an HSD17B13 gene, covalently attached to a molecule comprising a second dsRNA agent comprising a complex of ribonucleic acid molecules, having a duplex structure comprising two anti-parallel and substantially complementary nucleic acid strands, referred to as having "sense" and "antisense" orientations with respect to a second target RNA, i.e., a PNPLA3 gene. In some embodiments of the invention, a dual targeting RNAi agent triggers the degradation of the first and the second target RNAs, e.g., mRNAs, through a post-transcriptional gene-silencing mechanism referred to herein as RNA interference or RNAi.

The dsRNA agent may be administered to the subject at a dose of about 0.1 mg/kg to about 50 mg/kg. Typically, a suitable dose will be in the range of about 0.1 mg/kg to about 5.0 mg/kg, preferably about 0.3 mg/kg and about 3.0 mg/kg.

The iRNA can be administered by intravenous infusion over a period of time, on a regular basis. In certain embodiments, after an initial treatment regimen, the treatments can be administered on a less frequent basis.

Administration of the iRNA can reduce HSD17B13 levels, e.g., in a cell, tissue, blood, urine or other compartment of the patient by at least about 5%, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 39, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or at least about 99% or more. In a preferred embodiment, administration of the iRNA can reduce HSD17B13 levels, e.g., in a cell, tissue, blood, urine or other compartment of the patient by at least 20%.

Administration of the iRNA can reduce PNPLA3 levels, e.g., in a cell, tissue, blood, urine or other compartment of the patient by at least about 5%, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 39, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or at least about 99% or more. In a preferred embodiment, administration of the iRNA can reduce PNPLA3 levels, e.g., in a cell, tissue, blood, urine or other compartment of the patient by at least 20%.

Before administration of a full dose of the iRNA, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the iRNA can be administered subcutaneously, i.e., by subcutaneous injection. One or more injections may be used to deliver the desired daily dose of iRNA to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of iRNA on a regular basis, such as every other day or to once a year. In certain embodiments, the iRNA is administered about once per week, once every 7-10 days, once every 2 weeks, once every 3 weeks, once every 4 weeks, once every 5 weeks, once every 6 weeks, once every 7 weeks, once every 8 weeks, once every 9 weeks, once every 10 weeks, once every 11 weeks, once every 12 weeks, once per month, once every 2 months, once every 3 months once per quarter), once every 4 months, once every 5 months, or once every 6 months.

In one embodiment, the method includes administering a composition featured herein such that expression of the target HSD17B13 gene is decreased, such as for about 1, 2, 3, 4, 5, 6, 7, 8, 12, 16, 18, 24 hours, 28, 32, or about 36 hours. In one embodiment, expression of the target HSD17B13 gene is decreased for an extended duration, e.g., at least about two, three, four days or more, e.g., about one week, two weeks, three weeks, or four weeks or longer.

In another embodiment, the method includes administering a composition featured herein such that expression of the target PNPLA3 gene is decreased, such as for about 1, 2, 3, 4, 5, 6, 7, 8, 12, 16, 18, 24 hours, 28, 32, or about 36 hours. In one embodiment, expression of the target PNPLA3 gene is decreased for an extended duration, e.g., at least about two, three, four days or more, e.g., about one week, two weeks, three weeks, or four weeks or longer.

Preferably, the iRNAs useful for the methods and compositions featured herein specifically target RNAs (primary or processed) of the target HSD17B13 gene (and, in some embodiments, a PNPLA3 gene). Compositions and methods for inhibiting the expression of these genes using iRNAs can be prepared and performed as described herein.

Administration of the dsRNA according to the methods of the invention may result in a reduction of the severity, signs, symptoms, and/or markers of such diseases or disorders in a patient with a disorder of lipid metabolism. By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of a disorder of lipid metabolism may be assessed, for example, by periodic monitoring of one or more serum lipid levels, e.g., triglyceride levels. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA or pharmaceutical composition thereof, "effective against" a disorder of lipid metabolism indicates that administration in a clinically appropriate manner results in a beneficial effect for at least a statistically significant fraction of patients, such as a improvement of symptoms, a cure, a reduction in disease, extension of life, improvement in quality of life, or other effect generally recognized as positive by medical doctors familiar with treating disorder of lipid metabolisms and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art.

The invention further provides methods for the use of a iRNA agent or a pharmaceutical composition of the invention, e.g., for treating a subject that would benefit from reduction and/or inhibition of HSD17B13 expression or HSD17B13, e.g., a subject having an HSD17B13-associated disease disorder, or condition, in combination with other pharmaceuticals and/or other therapeutic methods, e.g., with known pharmaceuticals and/or known therapeutic methods, such as, for example, those which are currently employed for treating these disorders. In some embodiments, the invention provides methods for the use of a iRNA agent or a pharmaceutical composition of the invention and an iRNA agent targeting PNPLA3, e.g., for treating a subject that would benefit from reduction and/or inhibition of HSD17B13 expression and PNPLA3 expression, e.g., a subject having an HSD17B13-associated disease disorder, or condition (e.g., NASH), in combination with other pharmaceuticals and/or other therapeutic methods, e.g., with known pharmaceuticals and/or known therapeutic methods, such as, for example, those which are currently employed for treating these disorders. For example, in certain embodiments, an iRNA agent or pharmaceutical composition of the invention is administered in combination with, e.g., pyridoxine, an ACE inhibitor (angiotensin converting enzyme inhibitors), e.g., benazepril agents to decrease blood pressure, e.g., diuretics, beta-blockers, ACE inhibitors, angiotensin II receptor blockers, calcium channel blockers, alpha blockers, alpha-2 receptor antagonists, combined alpha- and beta-blockers, central agonists, peripheral adrenergic inhibitors, and blood vessel dialators; or agents to decrease cholesterol, e.g., statins, selective cholesterol absorption inhibitors, resins; lipid lowering therapies; insulin sensitizers, such as the PPARγ agonist pioglitazone; glp-1r agonists, such as liraglutatide; vitamin E; SGLT2 inhibitors; or DPPIV inhibitors; or a combination of any of the foregoing. In one embodiment, an iRNA agent or pharmaceutical composition of the invention is administered in combination with an agent that inhibits the expression and/or activity of a transmembrane 6 superfamily member 2 (TM6SF2) gene, e.g., an RNAi agent that inhibits the expression of a TM6SF2 gene.

The iRNA agent and an additional therapeutic agent and/or treatment may be administered at the same time and/or in the same combination, e.g., subcutaneously, or the additional therapeutic agent can be administered as part of a separate composition or at separate times and/or by another method known in the art or described herein.

VII. Kits

The present invention also provides kits for performing any of the methods of the invention. Such kits include one or more RNAi agent(s) and instructions for use, e.g., instructions for inhibiting expression of a HSD17B13 in a cell by contacting the cell with an RNAi agent or pharmaceutical composition of the invention in an amount effective to inhibit expression of the HSD17B13. The kits may optionally further comprise means for contacting the cell with the RNAi agent (e.g., an injection device), or means for measuring the inhibition of HSD17B13 (e.g., means for measuring the inhibition of HSD17B13 mRNA and/or HSD17B13 protein). Such means for measuring the inhibition of HSD17B13 may comprise a means for obtaining a sample from a subject, such as, e.g., a plasma sample. The kits of the invention may optionally further comprise means for administering the RNAi agent(s) to a subject or means for determining the therapeutically effective or prophylactically effective amount.

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1. iRNA Design, Synthesis, and Selection

This Example describes methods for the design, synthesis, and selection of HSD17B13 iRNA agents.
Source of Reagents
Where the source of a reagent is not specifically given herein, such reagent can be obtained from any supplier of reagents for molecular biology at a quality/purity standard for application in molecular biology.
Bioinformatics
A set of siRNAs targeting the human hydroxysteroid 17-beta dehydrogenase 13 gene (HSD17B13; human NCBI refseqID NM_178135.4; NCBI GeneID: 345275) as well the toxicology-species HSD17B13 ortholog from cynomolgus monkey: XM_005555367.2 was designed using custom R and Python scripts. All the siRNA designs have a perfect match to the human HSD17B13 transcript and a subset either perfect or near-perfect matches to the cynomolgus monkey ortholog. The human NM_178135 REFSEQ mRNA, version 4, has a length of 2397 bases. The rationale and method for the set of siRNA designs is as follows: the predicted efficacy for every potential 23mer siRNA from position 10 through the end was determined with a random forest model derived from the direct measure of mRNA knockdown from several thousand distinct siRNA designs targeting a diverse set of vertebrate genes. For each strand of the siRNA, a custom Python script was used in a brute force search to measure the number and positions of mismatches between the siRNA and all potential alignments in the human transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8, 1.2, 1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human and cynomolgus monkey was >=2 and predicted efficacy was >=50% knockdown.

A detailed list of the unmodified nucleotide sequences of the sense strand and antisense strand sequences is shown in Table 2.

A detailed list of the modified nucleotide sequences of the sense strand and antisense strand sequences is shown in Table 3.
In Vitro Cos-7 (Dual-Luciferase psiCHECK2 Vector), Primary Human Hepatocytes, and Primary Cynomolgus Hepatocytes Screening
Cell Culture and Transfections:
Cos-7 (ATCC) were transfected by adding 5 μl of 1 ng/ul, diluted in Opti-MEM, HSD17B13 psiCHECK2 vector (Blue Heron Biotechnology), 4.9 μl of Opti-MEM plus 0.1 μl of Lipofectamine 2000 per well (Invitrogen, Carlsbad Calif. cat #11668-019) to 5 μl of siRNA duplexes per well, with 4 replicates of each siRNA duplex, into a 384-well plate, and incubated at room temperature for 15 minutes. Thirty-five μl of Dulbecco's Modified Eagle Medium (ThermoFisher) containing ~5×10$^3$ cells were then added to the siRNA mixture. Cells were incubated for 48 hours followed by Firefly (transfection control) and *Renilla* (fused to target sequence) luciferase measurements. Single dose experiments were performed at 50 nM.

Primary Human Hepatocytes (BioIVT) were transfected by adding 4.9 μl of Opti-MEM plus 0.1 μl of RNAiMAX per well (Invitrogen, Carlsbad Calif. cat #13778-150) to 5 μl of siRNA duplexes per well, with 4 replicates of each siRNA duplex, into a 384-well plate, and incubated at room temperature for 15 minutes. Firthy μl of InVitroGRO CP plating media (BioIVT) containing ~15×10$^3$ cells were then added to the siRNA mixture. Cells were incubated for 48 hours prior to RNA purification. Single dose experiments were performed at 50 nM.

Primary Cynomolgus Hepatocytes (BioIVT) were transfected by adding 4.9 μl of Opti-MEM plus 0.1 μl of RNAiMAX per well (Invitrogen, Carlsbad Calif. cat #13778-150) to 5 μl of siRNA duplexes per well, with 4 replicates of each siRNA duplex, into a 384-well plate, and incubated at room temperature for 15 minutes. Firthy 1 of InVitroGRO CP plating media (BioIVT) containing ~5×10$^3$ cells were then added to the siRNA mixture. Cells were incubated for 48 hours prior to RNA purification. Single dose experiments were performed at 50 nM.

Total RNA Isolation Using DYNABEADS mRNA Isolation Kit:

RNA was isolated using an automated protocol on a BioTek-EL406 platform using DYNABEADs (Invitrogen, cat #61012). Briefly, 70 ul of Lysis/Binding Buffer and 10 ul of lysis buffer containing 3 ul of magnetic beads were added to the plate with cells. Plates were incubated on an electromagnetic shaker for 10 minutes at room temperature and then magnetic beads were captured and the supernatant was removed. Bead-bound RNA was then washed 2 times with 150 ul Wash Buffer A and once with Wash Buffer B. Beads were then washed with 150 ul Elution Buffer, re-captured and supernatant removed.

cDNA Synthesis Using ABI High Capacity cDNA Reverse Transcription Kit (Applied Biosystems. Foster City, Calif., Cat #4368813):

Ten μl of a master mix containing 1 μl 10× Buffer, 0.4 ul 25× dNTPs, 1 μl 10× Random primers, 0.5 μl Reverse Transcriptase, 0.5 l RNase inhibitor and 6.6 μl of H2O per reaction was added to RNA isolated above. Plates were sealed, mixed, and incubated on an electromagnetic shaker for 10 minutes at room temperature, followed by 2 h 37° C.

Real Time PCR:

Two μl of cDNA and 5 μl Lightcycler 480 probe master mix (Roche Cat #04887301001) were added to either 0.5 μl of Human GAPDH TaqMan Probe (4326317E) and 0.5 μl HSD17B13 Human probe (Hs01068199_m1, Thermo) or 0.5 μl Cyno GAPDH (custom) and 0.5 μl HSD17B13 Cyno probe (Mf02888851_m1, Thermo) per well in a 384 well plates (Roche cat #04887301001). Real time PCR was done in a LightCycler480 Real Time PCR system (Roche). Each duplex was tested at least two times and data were normalized to cells transfected with a non-targeting control siRNA. To calculate relative fold change, real time data were analyzed using the ΔΔCt method and normalized to assays performed with cells transfected with a non-targeting control siRNA.

Table 4 shows the results of a 50 nM single dose screen in Cos-7 (Dual-Luciferase psiCHECK2 vector) cells transfected with the indicate iRNA agents. Data are expressed as percent of message remaining relative to untreated cells.

Table 5 shows the results of a 50 nM single dose screen in Primary Human Hepatocytes transfected with the indicate iRNA agents. Data are expressed as percent of message remaining relative to untreated cells.

Table 6 shows the results of a 50 nM single dose screen in Primary Cynomolgus Hepatocytes transfected with the indicate iRNA agents. Data are expressed as percent of message remaining relative to untreated cells.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol |
| P | Phosphate |
| VP | Vinyl-phosphate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine-3'-phosphate |
| dTs | 2'-deoxythymidine-3'-phosphorothioate |
| dU | 2'-deoxyuridine |
| dUs | 2'-deoxyuridine-3'-phosphorothioate |
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| (Aam) | 2'-O-(N-methylacetamide)adenosine-3'-phosphate |
| (Aams) | 2'-O-(N-methylacetamide)adenosine-3'-phosphorothioate |
| (Gam) | 2'-O-(N-methylacetamide)guanosine-3'-phosphate |
| (Gams) | 2'-O-(N-methylacetamide)guanosine-3'-phosphorothioate |
| (Tam) | 2'-O-(N-methylacetamide)thymidine-3'-phosphate |
| (Tams) | 2'-O-(N-methylacetamide)thymidine-3'-phosphorothioate |
| (Aeo) | 2'-O-methoxyethyladenosine-3'-phosphate |
| (Aeos) | 2'-O-methoxyethyladenosine-3'-phosphorothioate |

TABLE 1-continued

Abbreviations of nucleotide monomers used in nucleic acid sequence representation.
It will be understood that these monomers, when present in an oligonucleotide, are mutually linked by 5'-3'-phosphodiester bonds.

| Abbreviation | Nucleotide(s) |
|---|---|
| (Geo) | 2'-O-methoxyethylguanosine-3'-phosphate |
| (Geos) | 2'-O-methoxyethylguanosine-3'-phosphorothioate |
| (Teo) | 2'-O-methoxyethyl-5-methyluridine-3'-phosphate |
| (Teos) | 2'-O-methoxyethyl-5-methyluridine-3'-phosphorothioate |
| (m5Ceo) | 2'-O-methoxyethyl-5-methylcytidine-3'-phosphate |
| (m5Ceos) | 2'-O-methoxyethyl-5-methylcytidine-3'-phosphorothioate |
| (A3m) | 3'-O-methyladenosine-2'-phosphate |
| (A3mx) | 3'-O-methyl-xylofuranosyladenosine-2'-phosphate |
| (G3m) | 3'-O-methylguanosine-2'-phosphate |
| (G3mx) | 3'-O-methyl-xylofuranosylguanosine-2'-phosphate |
| (C3m) | 3'-O-methylcytidine-2'-phosphate |
| (C3mx) | 3'-O-methyl-xylofuranosylcytidine-2'-phosphate |
| (U3m) | 3'-O-methyluridine-2'-phosphate |
| U3mx) | 3'-O-methyl-xylofuranosyluridine-2'-phosphate |
| (m5Cam) | 2'-O-(N-methylacetamide)-5-methylcytidine-3'-phosphate |
| (m5Cams) | 2'-O-(N-methylacetamide)-5-methylcytidine-3'-phosphorothioate |
| (Chd) | 2'-O-hexadecyl-cytidine-3'-phosphate |
| (Chds) | 2'-O-hexadecyl-cytidine-3'-phosphorothioate |
| (Uhd) | 2'-O-hexadecyl-uridine-3'-phosphate |
| (Uhds) | 2'-O-hexadecyl-uridine-3'-phosphorothioate |
| (pshe) | Hydroxyethylphosphorothioate |

[1] The chemical structure of L96 is as follows:

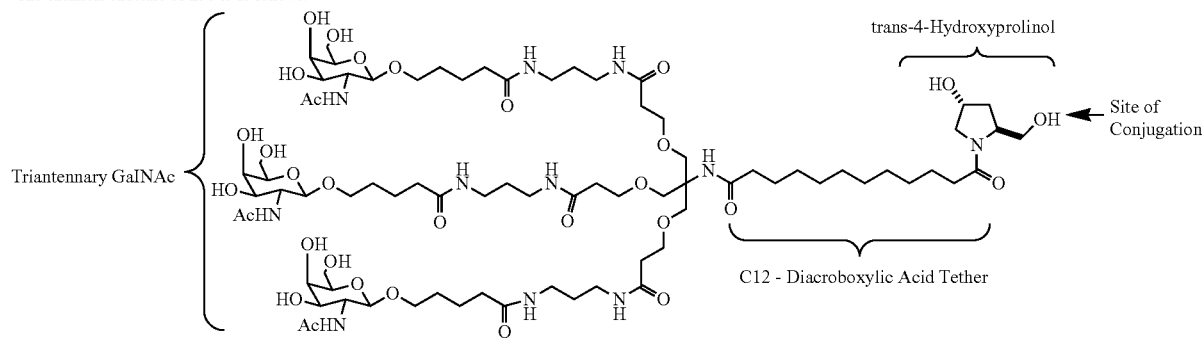

TABLE 2

HSD17B13 Unmodified Sequences

| Duplex Name | SEQ ID NO: | Sense Strand Sequence 5' to 3' | Range in NM_178135.4 | SEQ ID NO: | Antisense Strand Sequence 5' to 3' | Range in NM_178135.4 |
|---|---|---|---|---|---|---|
| AD-238911.1 | 3003 | CAGUACCUCCUCCCUAGGACU | 4-24 | 3299 | AGUCCUAGGGAGGAGGUACUGUC | 2-24 |
| AD-238912.1 | 3004 | AGUACCUCCUCCCUAGGACUA | 5-25 | 3300 | UAGUCCUAGGGAGGAGGUACUGU | 3-25 |
| AD-238913.1 | 3005 | GUACCUCCUCCCUAGGACUAA | 6-26 | 3301 | UUAGUCCUAGGGAGGAGGUACUG | 4-26 |
| AD-238929.1 | 3006 | ACUACACAAGGACUGAACCAA | 22-42 | 3302 | UUGGUUCAGUCCUUGUGUAGUCC | 20-42 |
| AD-238930.1 | 3007 | CUACACAAGGACUGAACCAGA | 23-43 | 3303 | UCUGGUUCAGUCCUUGUGUAGUC | 21-43 |
| AD-238932.1 | 3008 | ACACAAGGACUGAACCAGAAA | 25-45 | 3304 | UUUCUGGUUCAGUCCUUGUGUAG | 23-45 |
| AD-238960.1 | 3009 | CAGAGCAAAGCCAUGAACAUA | 54-74 | 3305 | UAUGUUCAUGGCUUUGCUCUGUC | 52-74 |
| AD-238979.1 | 3010 | UCAUCCUAGAAAAUCCUUCUGA | 73-93 | 3306 | UCAGAAGGAUUUCUAGGAUGAUG | 71-93 |
| AD-238991.1 | 3011 | UCCUUCUGCUUCUGAUCACCA | 85-105 | 3307 | UGGUGAUCAGAAGCAGAAGGAUU | 83-105 |
| AD-239009.1 | 3012 | CCAUCAUCUACUCCUACUUGA | 103-123 | 3308 | UCAAGUAGGAGUAGAUGAUGGUG | 101-123 |
| AD-239015.1 | 3013 | UCUACUCCUACUUGGAGUCGU | 109-129 | 3309 | ACGACUCCAAGUAGGAGUAGAUG | 107-129 |
| AD-239016.1 | 3014 | CUACUCCUACUUGGAGUCGUU | 110-130 | 3310 | AACGACUCCAAGUAGGAGUAGAU | 108-130 |
| AD-239017.7 | 3015 | UACUCCUACUUGGAGUCGUUA | 111-131 | 3311 | UAACGACUCCAAGUAGGAGUAGA | 109-131 |
| AD-239018.1 | 3016 | ACUCCUACUUGGAGUCGUUGA | 112-132 | 3312 | UCAACGACUCCAAGUAGGAGUAG | 110-132 |
| AD-239019.1 | 3017 | CUCCUACUUGGAGUCGUUGGU | 113-133 | 3313 | ACCAACGACUCCAAGUAGGAGUA | 111-113 |
| AD-239020.1 | 3018 | UCCUACUUGGAGUCGUUGGUA | 114-134 | 3314 | UACCAACGACUCCAAGUAGGAGU | 112-134 |
| AD-239031.1 | 3019 | GUCGUUGGUGAAGUUUUUCAU | 125-145 | 3315 | AUGAAAAACUUCACCAACGACUC | 123-145 |
| AD-239062.1 | 3020 | GAGAUUGUUCUCAUUACUGGA | 174-194 | 3316 | UCCAGUAAUGAGAACAAUCUCCC | 172-194 |
| AD-239066.1 | 3021 | UUGUUCUCAUUACUGGAGCUA | 178-198 | 3317 | UAGCUCCAGUAAUGAGAACAAUC | 176-198 |
| AD-239103.1 | 3022 | GCAGACUACUUAUGAAUUUGA | 215-235 | 3318 | UCAAAUUCAUAAGUAGUCUGCCU | 213-235 |
| AD-239110.1 | 3023 | ACUUAUGAAUUUGCAAAACGA | 222-242 | 3319 | UCGUUUUGCAAAUUCAUAAGUAG | 220-242 |
| AD-239118.1 | 3024 | AUUUGCAAAACGACAGAGCAU | 230-250 | 3320 | AUGCUCUGUCGUUUUGCAAAUUC | 228-250 |
| AD-239119.1 | 3025 | UUUGCAAAACGACAGAGCAUA | 231-251 | 3321 | UAUGCUCUGUCGUUUUGCAAAUU | 229-251 |
| AD-239131.1 | 3026 | CAGAGCAUAUUGGUUCUGUGA | 243-263 | 3322 | UCACAGAACCAAUAUGCUCUGUC | 241-263 |
| AD-239132.1 | 3027 | AGAGCAUAUUGGUUCUGUGGA | 244-264 | 3323 | UCCACAGAACCAAUAUGCUCUGU | 242-264 |

TABLE 2-continued

HSD17B13 Unmodified Sequences

| Duplex Name | SEQ ID NO: | Sense Strand Sequence 5' to 3' | Range in NM_178135.4 | SEQ ID NO: | Antisense Strand Sequence 5' to 3' | Range in NM_178135.4 |
|---|---|---|---|---|---|---|
| AD-239133.1 | 3028 | GAGCAUAUUGGUUCUGUGGGA | 245-265 | 3324 | UCCCACAGAACCAAUAUGCUCUG | 243-265 |
| AD-239146.1 | 3029 | CUGUGGGAUAUUAAUAAGCGA | 258-278 | 3325 | UCGCUUAUUAAUAUCCCACAGAA | 256-278 |
| AD-239155.1 | 3030 | AUUAAUAAGCGCGGUGUGGAA | 267-287 | 3326 | UUCCACACCGCGCUUAUUAAUAU | 265-287 |
| AD-239156.1 | 3031 | UUAAUAAGCGCGGUGUGGAGA | 268-288 | 3327 | UCUCCACACCGCGCUUAUUAAUA | 266-288 |
| AD-239177.1 | 3032 | AAACUGCAGCUGAGUGCCGAA | 289-309 | 3328 | UUCGGCACUCAGCUGCAGUUUCC | 287-309 |
| AD-239178.1 | 3033 | AACUGCAGCUGAGUGCCGAAA | 290-310 | 3329 | UUUCGGCACUCAGCUGCAGUUUC | 288-310 |
| AD-239179.1 | 3034 | ACUGCAGCUGAGUGCCGAAAA | 291-311 | 3330 | UUUUCGGCACUCAGCUGCAGUUU | 289-311 |
| AD-239180.1 | 3035 | CUGCAGCUGAGUGCCGAAAAC | 292-312 | 3331 | GUUUUCGGCACUCAGCUGCAGUU | 290-312 |
| AD-239181.1 | 3036 | UGCAGCUGAGUGCCGAAAACU | 293-313 | 3332 | AGUUUUCGGCACUCAGCUGCAGU | 291-313 |
| AD-239182.1 | 3037 | GCAGCUGAGUGCCGAAAACUA | 294-314 | 3333 | UAGUUUUCGGCACUCAGCUGCAG | 292-314 |
| AD-239183.1 | 3038 | CAGCUGAGUGCCGAAAACUAA | 295-315 | 3334 | UUAGUUUUCGGCACUCAGCUGCA | 293-315 |
| AD-239185.1 | 3039 | GCUGAGUGCCGAAAACUAGGA | 297-317 | 3335 | UCCUAGUUUUCGGCACUCAGCUG | 295-317 |
| AD-239186.1 | 3040 | CUGAGUGCCGAAAACUAGGCA | 298-318 | 3336 | UGCCUAGUUUUCGGCACUCAGCU | 296-318 |
| AD-239187.1 | 3041 | UGAGUGCCGAAAACUAGGCGU | 300-320 | 3337 | ACGCCUAGUUUUCGGCACUCAGC | 297-319 |
| AD-239188.1 | 3042 | GAGUGCCGAAAACUAGGCGUA | 301-321 | 3338 | UACGCCUAGUUUUCGGCACUCAG | 298-320 |
| AD-239189.1 | 3043 | AGUGCCGAAAACUAGGCGUCA | 304-324 | 3339 | UGACGCCUAGUUUUCGGCACUCA | 299-321 |
| AD-239190.1 | 3044 | GUGCCGAAAACUAGGCGUCAA | 305-325 | 3340 | UUGACGCCUAGUUUUCGGCACUC | 300-322 |
| AD-239191.1 | 3045 | UGCCGAAAACUAGGCGUCACU | 306-326 | 3341 | AGUGACGCCUAGUUUUCGGCACU | 301-323 |
| AD-239192.1 | 3046 | GCCGAAAACUAGGCGUCACUA | 308-328 | 3342 | UAGUGACGCCUAGUUUUCGGCAC | 302-324 |
| AD-239193.1 | 3047 | CCGAAAACUAGGCGUCACUGA | 310-330 | 3343 | UCAGUGACGCCUAGUUUUCGGCA | 303-325 |
| AD-239194.1 | 3048 | CGAAAACUAGGCGUCACUGCA | 311-331 | 3344 | UGCAGUGACGCCUAGUUUUCGGC | 304-326 |
| AD-239196.1 | 3049 | AAAACUAGGCGUCACUGCGCA | 315-335 | 3345 | UGCGCAGUGACGCCUAGUUUUCG | 306-328 |
| AD-239198.1 | 3050 | AACUAGGCGUCACUGCGCAUA | 326-346 | 3346 | UAUGCGCAGUGACGCCUAGUUUU | 308-330 |
| AD-239203.1 | 3051 | ACUAGGCGUCACUGCGCAUGA | 327-347 | 3347 | UCAUGCGCAGUGACGCCUAGUUU | 309-331 |
| AD-239214.1 | 3052 | GGCGUCACUGCGCAUGCGUAU | 244-264 | 3348 | AUACGCAUGCGCAGUGACGCCUA | 313-335 |
| AD-239215.1 | 3053 | GCAUGCGUAUGUGGUAGACUA | 245-265 | 3349 | UAGUCUACCACAUACGCAUGCGC | 324-346 |
| AD-239132.1 | 3054 | CAUGCGUAUGUGGUAGACUGA | 258-278 | 3350 | UCAGUCUACCACAUACGCAUGCG | 325-347 |
| AD-239239.1 | 3055 | AACAGAGAAGAGAUCUAUCGA | 351-371 | 3351 | UCGAUAGAUCUCUUCUCUGUUGC | 349-371 |
| AD-239240.1 | 3056 | ACAGAGAAGAGAUCUAUCGCU | 352-372 | 3352 | AGCGAUAGAUCUCUUCUCUGUUG | 350-372 |
| AD-239241.1 | 3057 | CAGAGAAGAGAUCUAUCGCUA | 353-373 | 3353 | UAGCGAUAGAUCUCUUCUCUGUU | 351-373 |
| AD-239242.1 | 3058 | AGAGAAGAGAUCUAUCGCUCU | 354-374 | 3354 | AGAGCGAUAGAUCUCUUCUCUGU | 352-374 |
| AD-239243.1 | 3059 | GAGAAGAGAUCUAUCGCUCUA | 355-375 | 3355 | UAGAGCGAUAGAUCUCUUCUCUG | 353-375 |
| AD-239245.1 | 3060 | GAAGAGAUCUAUCGCUCUCUA | 357-377 | 3356 | UAGAGAGCGAUAGAUCUCUUCUC | 355-377 |
| AD-239246.1 | 3061 | AAGAGAUCUAUCGCUCUCUAA | 358-378 | 3357 | UUAGAGAGCGAUAGAUCUCUUCU | 356-378 |
| AD-239247.1 | 3062 | AGAGAUCUAUCGCUCUCUAAA | 359-379 | 3358 | UUUAGAGAGCGAUAGAUCUCUUC | 357-379 |
| AD-239250.1 | 3063 | GAUCUAUCGCUCUCUAAAUCA | 362-382 | 3359 | UGAUUUAGAGCGAUAGAUCUC | 360-382 |
| AD-239251.1 | 3064 | AUCUAUCGCUCUCUAAAUCAA | 363-383 | 3360 | UUGAUUUAGAGAGCGAUAGAUCU | 361-383 |
| AD-239253.1 | 3065 | CUAUCGCUCUCUAAAUCAGGU | 365-385 | 3361 | ACCUGAUUUAGAGAGCGAUAGAU | 363-385 |
| AD-239254.1 | 3066 | UAUCGCUCUCUAAAUCAGGUA | 366-386 | 3362 | UACCUGAUUUAGAGAGCGAUAGA | 364-386 |
| AD-239255.1 | 3067 | AUCGCUCUCUAAAUCAGGUGA | 367-387 | 3363 | UCACCUGAUUUAGAGAGCGAUAG | 365-387 |
| AD-239290.1 | 3068 | GAUGUAACAAUCGUGGUGAAU | 402-422 | 3364 | AUUCACCACGAUUGUUACAUCAC | 400-422 |
| AD-239291.1 | 3069 | AUGUAACAAUCGUGGUGAAUA | 403-423 | 3365 | UAUUCACCACGAUUGUUACAUCA | 401-423 |
| AD-239292.1 | 3070 | UGUAACAAUCGUGGUGAAUAA | 404-424 | 3366 | UUAUUCACCACGAUUGUUACAUC | 402-424 |
| AD-239293.1 | 3071 | GUAACAAUCGUGGUGAAUAAU | 405-425 | 3367 | AUUAUUCACCACGAUUGUUACAU | 403-425 |
| AD-239304.1 | 3072 | GGUGAAUAAUGCUGGGACAGU | 416-436 | 3368 | ACUGUCCCAGCAUUAUUCACCAC | 414-436 |
| AD-239312.1 | 3073 | AUGCUGGGACAGUAUAUCCAA | 424-444 | 3369 | UUGGAUAUACUGUCCCAGCAUUA | 422-444 |
| AD-239313.1 | 3074 | UGCUGGGACAGUAUAUCCAGA | 425-445 | 3370 | UCUGGAUAUACUGUCCCAGCAUU | 423-445 |
| AD-239314.1 | 3075 | GCUGGGACAGUAUAUCCAGCA | 426-446 | 3371 | UGCUGGAUAUACUGUCCCAGCAU | 424-446 |
| AD-239316.1 | 3076 | UGGGACAGUAUAUCCAGCCGA | 428-448 | 3372 | UCGGCUGGAUAUACUGUCCCAGC | 426-448 |
| AD-239317.1 | 3077 | GGGACAGUAUAUCCAGCCGAU | 429-449 | 3373 | AUCGGCUGGAUAUACUGUCCCAG | 427-449 |
| AD-239318.1 | 3078 | GGACAGUAUAUCCAGCCGAUA | 430-450 | 3374 | UAUCGGCUGGAUAUACUGUCCCA | 428-450 |
| AD-239321.1 | 3079 | CAGUAUAUCCAGCCGAUCUUA | 433-453 | 3375 | UAAGAUCGGCUGGAUAUACUGUC | 431-453 |
| AD-239332.1 | 3080 | GCCGAUCUUCUCAGCACCAAA | 444-464 | 3376 | UUUGGUGCUGAGAAGAUCGGCUG | 442-464 |
| AD-239337.1 | 3081 | UCUUCUCAGCACCAAGGAUGA | 449-469 | 3377 | UCAUCCUUGGUGCUGAGAAGAUC | 447-469 |
| AD-239348.1 | 3082 | CCAAGGAUGAAGAGAUUACCA | 460-480 | 3378 | UGGUAAUCUCUUCAUCCUUGGUG | 458-480 |
| AD-239362.1 | 3083 | AUUACCAAGACAUUUGAGGUA | 474-494 | 3379 | UACCUCAAAUGUCUUGGUAAUCU | 472-494 |
| AD-239366.1 | 3084 | CCAAGACAUUUGAGGUCAACA | 478-498 | 3380 | UGUUGACCUCAAAUGUCUUGGUA | 476-498 |
| AD-239368.1 | 3085 | AAGACAUUUGAGGUCAACCGA | 480-500 | 3381 | UAUGUUGACCUCAAAUGUCUUGG | 478-500 |
| AD-239372.1 | 3086 | CAUUUGAGGUCAACAUCCUAA | 484-504 | 3382 | UUAGGAUGUUGACCUCAAAUGUC | 482-504 |
| AD-239373.1 | 3087 | AUUUGAGGUCAACAUCCUAGA | 485-505 | 3383 | UCUAGGAUGUUGACCUCAAAUGU | 483-505 |
| AD-239379.1 | 3088 | GGUCAACAUCCUAGGACAUUU | 491-511 | 3384 | AAAUGUCCUAGGAUGUUGACCUC | 489-511 |
| AD-239380.1 | 3089 | GUCAACAUCCUAGGACAUUUU | 492-512 | 3385 | AAAAUGUCCUAGGAUGUUGACCU | 490-512 |
| AD-239387.1 | 3090 | UCCUAGGACAUUUUGGAUCA | 499-519 | 3386 | UGAUCCAAAAUGUCCUAGGAUG | 497-519 |
| AD-239397.1 | 3091 | UUUUUGGAUCACAAAAGCACU | 509-529 | 3387 | AGUGCUUUUGUGAUCCAAAAAUG | 507-529 |
| AD-239411.1 | 3092 | AAGCACUUCUUCCAUCGAUGA | 523-543 | 3388 | UCAUCGAUGGAAGAAGUGCUUUU | 521-543 |
| AD-239412.1 | 3093 | AGCACUUCUUCCAUCGAUGAA | 524-544 | 3389 | AUCAUCGAUGGAAGAAGUGCUUU | 522-544 |
| AD-239431.1 | 3094 | AUGGAGAGAAAUCAUGGCCAA | 543-563 | 3390 | UUGGCCAUGAUUUCUCUCCAUCA | 541-563 |
| AD-239433.1 | 3095 | GGAGAGAAAUCAUGGCCACAU | 545-565 | 3391 | AUGUGGCCAUGAUUUCUCUCCAU | 543-565 |
| AD-239436.1 | 3096 | GAGAAAUCAUGGCCACAUCGU | 548-568 | 3392 | ACGAUGUGGCCAUGAUUUCUCUC | 546-568 |
| AD-239437.1 | 3097 | AGAAAUCAUGGCCACAUCGUA | 549-569 | 3393 | UACGAUGUGGCCAUGAUUUCUCU | 547-569 |
| AD-239438.1 | 3098 | GAAAUCAUGGCCACAUCGUCA | 550-570 | 3394 | UGACGAUGUGGCCAUGAUUUCUC | 548-570 |
| AD-239439.1 | 3099 | AAAUCAUGGCCACAUCGUCAA | 551-571 | 3395 | UUGACGAUGUGGCCAUGAUUUCU | 549-571 |
| AD-239450.1 | 3100 | ACAUCGUCACAGUGGCUUCAA | 562-582 | 3396 | UUGAAGCCACUGUGACGAUGUGG | 560-582 |
| AD-239451.1 | 3101 | CAUCGUCACAGUGGCUUCAGU | 563-583 | 3397 | ACUGAAGCCACUGUGACGAUGUG | 561-583 |
| AD-239452.1 | 3102 | AUCGUCACAGUGGCUUCAGUA | 564-584 | 3398 | UACUGAAGCCACUGUGACGAUGU | 562-584 |

TABLE 2-continued

HSD17B13 Unmodified Sequences

| Duplex Name | SEQ ID NO: | Sense Strand Sequence 5' to 3' | Range in NM_178135.4 | SEQ ID NO: | Antisense Strand Sequence 5' to 3' | Range in NM_178135.4 |
|---|---|---|---|---|---|---|
| AD-239453.1 | 3103 | UCGUCACAGUGGCUUCAGUGU | 565-585 | 3399 | ACACUGAAGCCACUGUGACGAUG | 563-585 |
| AD-239475.1 | 3104 | CGGCCACGAAGGGAUUCCUUA | 587-607 | 3400 | UAAGGAAUCCCUUCGUGGCCGCA | 585-607 |
| AD-239476.1 | 3105 | GGCCACGAAGGGAUUCCUUAA | 588-608 | 3401 | UUAAGGAAUCCCUUCGUGGCCGC | 586-608 |
| AD-239478.1 | 3106 | CCACGAAGGGAUUCCUUACCU | 590-610 | 3402 | AGGUAAGGAAUCCCUUCGUGGCC | 588-610 |
| AD-239479.1 | 3107 | CACGAAGGGAUUCCUUACCUA | 591-611 | 3403 | UAGGUAAGGAAUCCCUUCGUGGC | 589-611 |
| AD-239480.1 | 3108 | ACGAAGGGAUUCCUUACCUCA | 592-612 | 3404 | UGAGGUAAGGAAUCCCUUCGUGG | 590-612 |
| AD-239482.1 | 3109 | GAAGGGAUUCCUUACCUCAUA | 594-614 | 3405 | UAUGAGGUAAGGAAUCCCUUCGU | 592-614 |
| AD-239483.1 | 3110 | AAGGGAUUCCUUACCUCAUCA | 595-615 | 3406 | UGAUGAGGUAAGGAAUCCCUUCG | 593-615 |
| AD-239499.1 | 3111 | CAUCCCAUAUUGUUCCAGCAA | 611-631 | 3407 | UUGCUGGAACAAUAUGGGAUGAG | 609-631 |
| AD-239510.1 | 3112 | GUUCCAGCAAAUUUGCCGCUA | 622-642 | 3408 | UAGCGGCAAAUUUGCUGGAACAA | 620-642 |
| AD-239520.1 | 3113 | AUUUGCCGCUGUUGGCUUUCA | 632-652 | 3409 | UGAAAGCCAACAGCGGCAAAUUU | 630-652 |
| AD-239521.1 | 3114 | UUUGCCGCUGUUGGCUUUCAC | 633-653 | 3410 | UUGAAAGCCAACAGCGGCAAAUU | 631-653 |
| AD-239522.1 | 3115 | UUGCCGCUGUUGGCUUUCACA | 634-654 | 3411 | UGUGAAAGCCAACAGCGGCAAAU | 632-654 |
| AD-239534.1 | 3116 | GCUUUCACAGAGGUCUGACAU | 634-654 | 3412 | AUGUCAGACCUCUGUGAAAGCCA | 644-666 |
| AD-239539.1 | 3117 | CACAGAGGUCUGACAUCAGAA | 646-666 | 3413 | UUCUGAUGUCAGACCUCUGUGAA | 649-671 |
| AD-239544.1 | 3118 | AGGUCUGACAUCAGAACUUCA | 651-671 | 3414 | UGAAGUUCUGAUGUCAGACCUCU | 654-679 |
| AD-239566.1 | 3119 | GCCUUGGGAAAAACUGGUAUA | 656-676 | 3415 | UAUACCAGUUUUUCCCAAGGCCU | 676-698 |
| AD-239578.1 | 3120 | ACUGGUAUCAAAACCUCAUGU | 678-698 | 3416 | ACAUGAGGUUUUGAUACCAGUUU | 688-710 |
| AD-239579.1 | 3120 | CUGGUAUCAAAACCUCAUGUA | 690-710 | 3417 | UACAUGAGGUUUUGAUACCAGUU | 689-711 |
| AD-239611.1 | 3122 | UUUGUGAAUACUGGGUUCACA | 691-711 | 3418 | UGUGAACCCAGUAUUCACAAAAA | 721-743 |
| AD-239612.1 | 3123 | UUGUGAAUACUGGGUUCACCA | 723-743 | 3419 | UGGUGAACCCAGUAUUCACAAAA | 722-744 |
| AD-239513.1 | 3134 | UGUGAAUACUGGGUUCACCAA | 724-744 | 3420 | UUGGUGAACCCAGUAUUCACAAA | 723-745 |
| AD-239617.1 | 3125 | AAUACUGGGUUCACCAAAAAU | 725-745 | 3421 | AUUUUUGGUGAACCCAGUAUUCA | 727-749 |
| AD-239618.1 | 3126 | AUACUGGGUUCACCAAAAAUA | 729-749 | 3422 | UAUUUUUGGUGAACCCAGUAUUC | 728-750 |
| AD-239637.1 | 3127 | UCCAAGCACAAGAUUAUGGCA | 730-750 | 3423 | UGCCAUAAUCUUGUGCUUGGAUU | 747-769 |
| AD-239641.1 | 3128 | AGCACAAGAUUAUGGCCUGUA | 749-769 | 3424 | UACAGGCCAUAAUCUUGUGCUUG | 751-773 |
| AD-239642.1 | 3129 | GCACAAGAUUAUGGCCUGUAU | 753-773 | 3425 | AUACAGGCCAUAAUCUUGUGCUU | 752-774 |
| AD-239643.1 | 3130 | CACAAGAUUAUGGCCUGUAUU | 754-774 | 3426 | AAUACAGGCCAUAAUCUUGUGCU | 753-775 |
| AD-239645.1 | 3131 | CAAGAUUAUGGCCUGUAUUGA | 755-775 | 3427 | UCAAUACAGGCCAUAAUCUUGUG | 755-777 |
| AD-239647.1 | 3132 | AGAUUAUGGCCUGUAUUGGAA | 757-777 | 3428 | UUCCAAUACAGGCCAUAAUCUUG | 757-779 |
| AD-239649.1 | 3133 | AUUAUGGCCUGUAUUGGAGAA | 759-779 | 3429 | UUCUCCAAUACAGGCCAUAAUCU | 759-781 |
| AD-239650.1 | 3134 | UUAUGGCCUGUAUUGGAGACA | 761-781 | 3430 | UGUCUCCAAUACAGGCCAUAAUC | 760-782 |
| AD-239653.1 | 3135 | UGGCCUGUAUUGGAGACAGAU | 762-785 | 3431 | AUCUGUCUCCAAUACAGGCCAUA | 763-785 |
| AD-239654.1 | 3136 | GGCCUGUAUUGGAGACAGAUA | 766-786 | 3432 | UAUCUGUCUCCAAUACAGGCCAU | 764-786 |
| AD-239662.1 | 3137 | UUGGAGACAGAUGAAGUCGUA | 774-794 | 3433 | UACGACUUCAUCUGUCUCCAAUA | 772-794 |
| AD-239568.1 | 3138 | ACAGAUGAAGUCGUAAGAAGU | 780-800 | 3434 | ACUUCUUACGACUUCAUCUGUCU | 778-800 |
| AD-239669.1 | 3139 | CAGAUGAAGUCGUAAGAAGUA | 781-801 | 3435 | UACUUCUUACGACUUCAUCUGUC | 779-801 |
| AD-239670.1 | 3140 | AGAUGAAGUCGUAAGAAGUCU | 782-802 | 3436 | AGACUUCUUACGACUUCAUCUGU | 780-802 |
| AD-239671.1 | 3141 | GAUGAAGUCGUAAGAAGUCUA | 783-803 | 3437 | UAGACUUCUUACGACUUCAUCUG | 781-803 |
| AD-239674.1 | 3142 | GAAGUCGUAAGAAGUCUGAUA | 786-806 | 3438 | UAUCAGACUUCUUACGACUUCAU | 784-806 |
| AD-239676.1 | 3143 | AGUCGUAAGAAGUCUGAUAGA | 788-808 | 3439 | UCUAUCAGACUUCUUACGACUUC | 786-808 |
| AD-239681.1 | 3144 | UAAGAAGUCUGAUAGAUGGAA | 793-813 | 3440 | UUCCAUCUAUCAGACUUCUUACG | 791-813 |
| AD-239682.1 | 3145 | AAGAAGUCUGAUAGAUGGAAU | 794-814 | 3441 | AUUCCAUCUAUCAGACUUCUUAC | 792-814 |
| AD-239684.1 | 3146 | GAAGUCUGAUAGAUGGAAUAA | 796-816 | 3442 | UUAUUCCAUCUAUCAGACUUCUU | 794-816 |
| AD-239685.1 | 3147 | AAGUCUGAUAGAUGGAAUACU | 797-817 | 3443 | AGUAUUCCAUCUAUCAGACUUCU | 795-817 |
| AD-239697.1 | 3148 | UGGAAUACUUACCAAUAAGAA | 809-829 | 3444 | UUCUUAUUGGUAAGUAUUCCAUC | 807-829 |
| AD-239713.1 | 3149 | AAUGAUUUUGUUCCAUCGUA | 830-850 | 3445 | UACGAUGGAACAAAAAUCAUUUU | 828-850 |
| AD-239714.1 | 3150 | AUGAUUUUGUUCCAUCGUAU | 831-851 | 3446 | AUACGAUGGAACAAAAAUCAUUU | 829-851 |
| AD-239717.1 | 3151 | AUUUUGUUCCAUCGUAUAUCA | 834-854 | 3447 | UAUAUACGAUGGAACAAAAAUCA | 832-854 |
| AD-239721.1 | 3152 | UUGUUCCAUCGUAUAUCAAUA | 838-858 | 3448 | UAUUGAUAUACGAUGGAACAAAA | 836-858 |
| AD-239723.1 | 3153 | GUUCCAUCGUAUAUCAAUAUA | 840-860 | 3449 | UAUAUUGAUAUACGAUGGAACAA | 838-860 |
| AD-239724.1 | 3154 | UUCCAUCGUAUAUCAAUAUCU | 841-861 | 3450 | AGAUAUUGAUAUACGAUGGAACA | 839-861 |
| AD-239725.1 | 3155 | UCCAUCGUAUAUCAAUAUCUU | 842-862 | 3451 | AAGAUAUUGAUAUACGAUGGAAC | 840-862 |
| AD-239726.1 | 3156 | CCAUCGUAUAUCAAUAUCUUU | 843-863 | 3452 | AAAGAUAUUGAUAUACGAUGGAA | 841-863 |
| AD-239755.1 | 3157 | ACAGAAGUUUCUUCCUGAACA | 872-892 | 3453 | UGUUCAGGAAGAAACUUCUGUAG | 870-892 |
| AD-239757.1 | 3158 | AGAAGUUUCUUCCUGAACGCA | 874-894 | 3454 | UGCGUUCAGGAAGAAACUUCUGU | 872-894 |
| AD-239759.1 | 3159 | AAGUUUCUUCCUGAACGCGCA | 876-896 | 3455 | UGCGCGUUCAGGAAGAAACUUCU | 874-896 |
| AD-239761.1 | 3160 | GUUUCUUCCUGAACGCGCCUA | 878-898 | 3456 | UAGGCGCGUUCAGGAAGAAACUU | 876-898 |
| AD-239764.1 | 3161 | UCUUCCUGAACGCGCCUCAGA | 881-901 | 3457 | UCUGAGGCGCGUUCAGGAAGAAA | 879-901 |
| AD-239778.1 | 3162 | CCUCAGCGAUUUUAAAUCGUA | 895-915 | 3458 | UACGAUUUAAAAUCGCUGAGGCG | 893-915 |
| AD-239779.1 | 3163 | CUCAGCGAUUUUAAAUCGUAU | 896-916 | 3459 | AUACGAUUUAAAAUCGCUGAGGC | 894-916 |
| AD-239780.1 | 3164 | UCAGCGAUUUUAAAUCGUAUA | 897-917 | 3460 | UAUACGAUUUAAAAUCGCUGAGG | 895-917 |
| AD-239781.1 | 3165 | CAGCGAUUUUAAAUCGUAUGA | 898-918 | 3461 | UCAUACGAUUUAAAAUCGCUGAG | 896-918 |
| AD-239782.1 | 3166 | AGCGAUUUUAAAUCGUAUGCA | 899-919 | 3462 | UGCAUACGAUUUAAAAUCGCUGA | 897-919 |
| AD-239783.1 | 3167 | GCGAUUUUAAAUCGUAUGCAA | 900-920 | 3463 | UUGCAUACGAUUUAAAAUCGCUG | 898-920 |
| AD-239784.1 | 3168 | CGAUUUUAAAUCGUAUGCAGA | 901-921 | 3464 | UCUGCAUACGAUUUAAAAUCGCU | 899-921 |
| AD-239785.1 | 3169 | GAUUUUAAAUCGUAUGCAGAA | 902-922 | 3465 | UUCUGCAUACGAUUUAAAAUCGC | 900-922 |
| AD-239786.1 | 3170 | AUUUUAAAUCGUAUGCAGAAU | 903-923 | 3466 | AUUCUGCAUACGAUUUAAAAUCG | 901-923 |
| AD-239787.1 | 3171 | UUUUAAAUCGUAUGCAGAAUA | 904-924 | 3467 | UAUUCUGCAUACGAUUUAAAAUC | 902-924 |
| AD-239791.1 | 3172 | AAAUCGUAUGCAGAAUAUUCA | 908-928 | 3468 | UGAAUAUUCUGCAUACGAUUUAA | 906-928 |
| AD-239793.1 | 3173 | AUCGUAUGCAGAAUAUUCAAU | 910-930 | 3469 | AUUGAAUAUUCUGCAUACGAUUU | 908-930 |
| AD-239806.1 | 3174 | UAUUCAAUUGAAGCAGUGGU | 923-943 | 3470 | ACCACUGCUUCAAAUUGAAUAUU | 921-943 |
| AD-239839.1 | 3175 | GAAUAAAUAAGCUCCAGCCAA | 697-987 | 3471 | UUGGCUGGAGCUUAUUUAUUCAU | 965-987 |
| AD-239840.1 | 3176 | AAUAAAUAAGCUCCAGCAGA | 968-988 | 3472 | UCUGGCUGGAGCUUAUUUAUUCA | 966-988 |
| AD-239854.1 | 3177 | AGCCAGAGAUGUAUGCAUGAU | 982-1002 | 3473 | AUCAUGCAUACAUCUCUGGCUGG | 980-1002 |

TABLE 2-continued

HSD17B13 Unmodified Sequences

| Duplex Name | SEQ ID NO: | Sense Strand Sequence 5' to 3' | Range in NM_178135.4 | SEQ ID NO: | Antisense Strand Sequence 5' to 3' | Range in NM_178135.4 |
|---|---|---|---|---|---|---|
| AD-239855.1 | 3178 | GCCAGAGAUGUAUGCAUGAUA | 983-1003 | 3474 | UAUCAUGCAUACAUCUCUGGCUG | 981-1003 |
| AD-239876.1 | 3179 | AUAUGAAUAGUUUCGAAUCAA | 1007-1027 | 3475 | UUGAUUCGAAACUAUUCAUAUCA | 1005-1027 |
| AD-239877.1 | 3180 | UAUGAAUAGUUUCGAAUCAAU | 1008-1028 | 3476 | AUUGAUUCGAAACUAUUCAUAUC | 1006-1028 |
| AD-239881.1 | 3181 | AAUAGUUUCGAAUCAAUGCUA | 1012-1032 | 3477 | UAGCAUUGAUUCGAAACUAUUCA | 1010-1032 |
| AD-239905.1 | 3182 | UUCAGUCCUGAUAAUAUUAAA | 1054-1074 | 3478 | UUUAAUAUUAUCAGGACUGAAAA | 1052-1074 |
| AD-239914.1 | 3183 | AAAAACAUUGGUUUGGCACUA | 1072-1092 | 3479 | UAGUGCCAAACCAAUGUUUUUAA | 1070-1092 |
| AD-239915.1 | 3184 | AAAACAUUGGUUUGGCACUAA | 1073-1093 | 3480 | UUAGUGCCAAACCAAUGUUUUUA | 1071-1093 |
| AD-239941.1 | 3185 | GUCAAACGAACAAGAUUAAUU | 1099-1119 | 3481 | AAUUAAUCUUGUUCGUUUGACUG | 1097-1119 |
| AD-239944.1 | 3186 | AAACGAACAAGAUUAAUUACA | 1102-1122 | 3482 | UGUAAUUAAUCUUGUUCGUUUGA | 1100-1122 |
| AD-239945.1 | 3187 | AACGAACAAGAUUAAUUACCU | 1103-1123 | 3483 | AGGUAAUUAAUCUUGUUCGUUUG | 1101-1123 |
| AD-239946.1 | 3188 | ACGAACAAGAUUAAUUACCUA | 1104-1124 | 3484 | UAGGUAAGGAAUCUUGUUCGUUU | 1102-1124 |
| AD-239947.1 | 3189 | CGAACAAGAUUAAUUACCUGU | 1105-1125 | 3485 | ACAGGUAAUUAAUCUUGUUCGUU | 1103-1125 |
| AD-239977.1 | 3190 | UCUCAAGAAUAUUUACGUAGU | 1135-1155 | 3486 | ACUACGUAAAUAUUCUUGAGAAA | 1133-1155 |
| AD-239979.1 | 3191 | UCAAGAAUAUUUACGUAGUUU | 1137-1157 | 3487 | AAACUACGUAAAUAUUCUUGAGA | 1135-1157 |
| AD-239980.1 | 3192 | CAAGAAUAUUUACGUAGUUUU | 1138-1158 | 3488 | AAAACUACGUAAAUAUUCUUGAG | 1136-1158 |
| AD-239998.1 | 3193 | UUUCAUAGGUCUGUUUUGACU | 1157-1177 | 3489 | AGGAAAAACAGACCUAUGAAAAA | 1155-1177 |
| AD-240019.1 | 3194 | UUCAUGCCUCUUAAAAACUUA | 1178-1198 | 3490 | UAAGUUUUUAAGAGGCAUGAAAG | 1176-1198 |
| AD-240031.1 | 3195 | AAAAACUUCUGUGCUUACAUA | 1190-1210 | 3491 | UAUGUAAGCACAGAAGUUUUUAA | 1188-1210 |
| AD-240032.1 | 3196 | AAAACUUCUGUGCUUACAUAA | 1191-1211 | 3492 | UUAUGUAAGCACAGAAGUUUUUA | 1189-1211 |
| AD-240033.1 | 3197 | AAACUUCUGUGCUUACAUAAA | 1192-1212 | 3493 | UUUAUGUAAGCACAGAAGUUUUU | 1190-1212 |
| AD-240064.1 | 3198 | UUUUUCCAUUUAAAGGUGGAA | 1245-1265 | 3494 | UUCCACCUUUAAAUGGAAAAAUA | 1243-1265 |
| AD-240090.1 | 3199 | CUACCUCCCUAAAAGUAAAUA | 1271-1291 | 3495 | UAUUUACUUUUAGGGAGGUAGCU | 1269-1291 |
| AD-240091.1 | 3200 | UACCUCCCUAAAAGUAAAUAA | 1272-1292 | 3496 | UUAUUUACUUUUAGGGAGGUAGC | 1270-1292 |
| AD-240108.1 | 3201 | UACAAAGAGAACUUAUUUACA | 1290-1310 | 3497 | UGUAAAUAAGUUCUCUUUGUAUU | 1288-1310 |
| AD-240117.1 | 3202 | AACUUAUUUACACAGGGAAGA | 1299-1319 | 3498 | UCUUCCCUGUGUAAAUAAGUUCU | 1297-1319 |
| AD-240124.1 | 3203 | UUACACAGGGAAGGUUUAAGA | 1306-1326 | 3499 | UCUUAAACCUUCCCUGUGUAAAU | 1304-1326 |
| AD-240125.1 | 3204 | UACACAGGGAAGGUUUAAGAA | 1307-1327 | 3500 | UUCUUAAACCUUCCCUGUGUAAA | 1305-1327 |
| AD-240126.1 | 3205 | ACACAGGGAAGGUUUAAGACU | 1308-1328 | 3501 | AGUCUUAAACCUUCCCUGUGUAA | 1306-1328 |
| AD-240135.1 | 3206 | AGGUUUAAGACUGUUCAAGUA | 1317-1337 | 3502 | UACUUGAACAGUCUUAAACCUUC | 1315-1337 |
| AD-240138.1 | 3207 | UUUAAGACUGUUCAAGUAGCA | 1320-1340 | 3503 | UGCUACUUGAACAGUCUUAAACC | 1318-1340 |
| AD-240140.1 | 3208 | UAAGACUGUUCAAGUAGCAUU | 1322-1342 | 3504 | AAUGCUACUUGAACAGUCUUAAA | 1320-1342 |
| AD-240142.1 | 3209 | AGACUGUUCAAGUAGCAUUCC | 1324-1344 | 3505 | UGAAUGCUACUUGAACAGUCUUA | 1322-1344 |
| AD-240145.1 | 3210 | CUGUUCAAGUAGCAUUCCAAU | 1327-1347 | 3506 | AUUGGAAUGCUACUUGAACAGUC | 1325-1347 |
| AD-240147.1 | 3211 | GUUCAAGUAGCAUUCCAAUCU | 1329-1349 | 3507 | AGAUUGGAAUGCUACUUGAACAG | 1327-1349 |
| AD-240148.1 | 3212 | UUCAAGUAGCAUUCCAAUCUA | 1330-1350 | 3508 | UAGAUUGGAAUGCUACUUGAACA | 1328-1350 |
| AD-240154.1 | 3213 | UAGCAUUCCAAUCUGUAGCCA | 1336-1356 | 3509 | UGGCUACAGAUUGGAAUGCUACU | 1334-1356 |
| AD-240155.1 | 3214 | AGCAUUCCAAUCUGUAGCCAU | 1337-1357 | 3510 | AUGGCUACAGAUUGGAAUGCUAC | 1335-1357 |
| AD-240156.1 | 3215 | GCAUUCCAAUCUGUAGCCAUA | 1338-1358 | 3511 | UAUGGCUACAGAUUGGAAUGCUA | 1336-1358 |
| AD-240171.1 | 3216 | GCCAUGCCACAGAAUAUCAAA | 1353-1373 | 3512 | UUUGAUAUUCUGUGGCAUGGCUA | 1351-1373 |
| AD-240172.1 | 3217 | CCAUGCCACAGAAUAUCAACA | 1354-1374 | 3513 | UGUUGAUAUUCUGUGGCAUGGCU | 1352-1374 |
| AD-240192.1 | 3218 | AAGAACACAGAAUGAGUGACU | 1374-1394 | 3514 | UUGCACUCAUUCUGUGUUCUUGU | 1372-1394 |
| AD-240227.1 | 3219 | GUUUCAGCAGGCAGCUUUAUA | 1409-1429 | 3515 | UAUAAAGCUGCCUGCUGAAACUU | 1407-1429 |
| AD-240228.1 | 3220 | UUUCAGCAGGCAGCUUUAUCU | 1410-1430 | 3516 | AGAUAAAGCUGCCUGCUGAAACU | 1408-1430 |
| AD-240237.1 | 3221 | GCAGCUUUAUCUCAACCUGGA | 1419-1439 | 3517 | UCCAGGUUGAGAUAAAGCUGCCU | 1417-1439 |
| AD-240245.1 | 3222 | AUCUCAACCUGGACAUAUUUU | 1427-1447 | 3518 | AAAAAUAUGUCCAGGUUGAGAUAA | 1425-1447 |
| AD-240276.1 | 3223 | AUUUGAAAGAUUUCCCUAGCA | 1458-1478 | 3519 | UGCUAGGGAAAUCUUUCAAAUGC | 1456-1478 |
| AD-240278.1 | 3224 | UUGAAAGAUUUCCCUAGCCUA | 1460-1480 | 3520 | UAGGCUAGGGAAAUCUUUCAAAU | 1458-1480 |
| AD-240279.1 | 3225 | UGAAAGAUUUCCCUAGCCUCU | 1461-1481 | 3521 | AGAGGCUAGGGAAAUCUUUCAAA | 1459-1481 |
| AD-240280.1 | 3226 | GAAAGAUUUCCCUAGCCUCUA | 1462-1482 | 3522 | AAGAGGCUAGGGAAAUCUUUCAA | 1460-1482 |
| AD-240308.1 | 3227 | CAUUAGCCCAAAACGGUGCAA | 1490-1510 | 3523 | UUGCACCGUUUUGGGCUAAUGAA | 1488-1510 |
| AD-240309.1 | 3228 | AUUAGCCCAAAACGGUGCAAA | 1491-1511 | 3524 | UUUGCACCGUUUUGGGCUAAUGA | 1489-1511 |
| AD-240310.1 | 3229 | UUAGCCCAAAACGGUGCAACU | 1492-1512 | 3525 | AGUUGCACCGUUUUGGGCUAAUG | 1490-1512 |
| AD-240311.1 | 3230 | UAGCCCAAAACGGUGCAACUA | 1493-1513 | 3526 | UAGUUGCACCGUUUUGGGCUAAU | 1491-1513 |
| AD-240312.1 | 3231 | AGCCCAAAACGGUGCAACUCU | 1494-1514 | 3527 | AGAGUUGCACCGUUUUGGGCUAA | 1492-1514 |
| AD-240313.1 | 3232 | GCCCAAAACGGUGCAACUCUA | 1495-1515 | 3528 | UAGAGUUGCACCGUUUUGGGCUA | 1493-1515 |
| AD-240315.1 | 3233 | CCAAAACGGUGCAACUCUAUU | 1467-1517 | 3529 | AAUAGAGUUGCACCGUUUUGGGC | 1495-1517 |
| AD-240317.1 | 3234 | AAAACGGUGCAACUCUAUUCU | 1499-1519 | 3530 | AGAAUAGAGUUGCACCGUUUUGG | 1497-1519 |
| AD-240318.1 | 3235 | AAACGGUGCAACUCUAUUCUA | 1500-1520 | 3531 | UAGAAUAGAGUUGCACCGUUUUG | 1498-1520 |
| AD-240319.1 | 3236 | AACGGUGCAACUCUAUUCUGA | 1501-1521 | 3532 | UCAGAAUAGAGUUGCACCGUUUU | 1499-1521 |
| AD-240322.1 | 3237 | GGUGCAACUCUAUUCUGGACU | 1504-1524 | 3533 | AGUCCAGAAUAGAGUUGCACCGU | 1502-1524 |
| AD-240324.1 | 3238 | UGCAACUCUAUUCUGGACUUU | 1506-1526 | 3534 | AAAGUCCAGAAUAGAGUUGCACC | 1504-1526 |
| AD-240326.1 | 3239 | CAACUCUAUUCUGGACUUUAU | 1508-1528 | 3535 | AUAAAGUCCAGAAUAGAGUUGCA | 1506-1528 |
| AD-240327.1 | 3240 | AACUCUAUUCUGGACUUUAUU | 1509-1529 | 3536 | AAUAAAGUCCAGAAUAGAGUUGC | 1507-1529 |
| AD-240333.1 | 3241 | AUUCUGGACUUUAUUACUUGA | 1515-1535 | 3537 | UCAAGUAAUAAAGUCCAGAAUAG | 1513-1535 |
| AD-240364.1 | 3242 | UGUAUAACUCUGAAGUCCACA | 1546-1566 | 3538 | UGUGGACUUCAGAGUUAUACAGA | 1544-1566 |
| AD-240365.1 | 3243 | GUAUAACUCUGAAGUCCACAA | 1547-1567 | 3539 | UUGUGGACUUCAGAGUUAUACAG | 1545-1567 |
| AD-240375.1 | 3244 | GAAGUCCACCAAAAGUGGACA | 1557-1577 | 3540 | UGUCCACUUUUGGUGGACUUCAG | 1555-1577 |
| AD-240378.1 | 3245 | GUCCACCAAAAGUGGACCCUA | 1560-1580 | 3541 | UAGGGUCCACUUUUGGUGGACUU | 1558-1580 |
| AD-240381.1 | 3246 | CACCAAAAGUGGACCCUCUAU | 1563-1583 | 3542 | AUAGAGGGUCCACUUUUGGUGGA | 1561-1583 |
| AD-240382.1 | 3247 | ACCAAAAGUGGACCCUCUAUA | 1564-1584 | 3543 | UAUAGAGGGUCCACUUUUGGUGG | 1562-1584 |
| AD-240383.1 | 3248 | CCAAAAGUGGACCCUCUAUAU | 1565-1585 | 3544 | AUAUAGAGGGUCCACUUUUGGUG | 1563-1585 |
| AD-240385.1 | 3249 | AAAAGUGGACCCUCUAUAUUU | 1567-1587 | 3545 | AAAUAUAGAGGGUCCACUUUUGG | 1565-1587 |
| AD-240386.1 | 3250 | AAAGUGGACCCUCUAUAUUUA | 1568-1588 | 3546 | UAAAUAUAGAGGGUCCACUUUUG | 1566-1588 |
| AD-240387.1 | 3251 | AAGUGGACCCUCUAUAUUUCA | 1569-1589 | 3547 | UGAAAUAUAGAGGGUCCACUUUU | 1567-1589 |
| AD-240419.1 | 3252 | AUACAUUAUGAAAGGUGACCA | 1612-1632 | 3548 | UGGUCACCUUUCAUAAUGUAUCU | 1610-1632 |

TABLE 2-continued

HSD17B13 Unmodified Sequences

| Duplex Name | SEQ ID NO: | Sense Strand Sequence 5' to 3' | Range in NM_178135.4 | SEQ ID NO: | Antisense Strand Sequence 5' to 3' | Range in NM_178135.4 |
|---|---|---|---|---|---|---|
| AD-240420.1 | 3253 | UACAUUAUGAAAGGUGACCGA | 1613-1633 | 3549 | UCGGUCACCUUUCAUAAUGUAUC | 1611-1633 |
| AD-240421.1 | 3254 | ACAUUAUGAAAGGUGACCGAA | 1614-1634 | 3550 | UUCGGUCACCUUUCAUAAUGUAU | 1612-1634 |
| AD-240422.1 | 3255 | CAUUAUGAAAGGUGACCGACU | 1615-1635 | 3551 | AGUCGGUCACCUUUCAUAAUGUA | 1613-1635 |
| AD-240423.1 | 3256 | AUUAUGAAAGGUGACCGACUA | 1616-1636 | 3552 | UAGUCGGUCACCUUUCAUAAUGU | 1614-1636 |
| AD-240431.1 | 3257 | AGGUGACCGACUCUAUUUAA | 1624-1644 | 3553 | UUAAAAUAGAGUCGGUCACCUUU | 1622-1644 |
| AD-240446.1 | 3258 | AUCUCAGAAUUUUAAGUUCUA | 1645-1665 | 3554 | UAGAACUUAAAAUUCUGAGAUUU | 1643-1665 |
| AD-240474.1 | 3259 | CUUUCAUAUAUCCUUGGUCCA | 1699-1719 | 3555 | UGGACCAAGGAUAUAUGAAAGCA | 1697-1719 |
| AD-240475.1 | 3260 | UUUCAUAUAUCCUUGGUCCCA | 1700-1720 | 3556 | UGGGACCAAGGAUAUAUGAAAGC | 1698-1720 |
| AD-240476.1 | 3261 | UUCAUAUAUCCUUGGUCCCAA | 1701-1721 | 3557 | UUGGGACCAAGGAUAUAUGAAAG | 1699-1721 |
| AD-240490.1 | 3262 | GUCCCAGAGAUGUUUAGACAA | 1715-1735 | 3558 | UUGUCUAAACAUCUCUGGGACCA | 1713-1735 |
| AD-240494.1 | 3263 | CAGAGAUGUUUAGACAAUUUU | 1719-1739 | 3559 | AAAAUUGUCUAAACAUCUCUGGG | 1717-1739 |
| AD-240495.1 | 3264 | AGAGAUGUUUAGACAAUUUUA | 1720-1740 | 3560 | UAAAAUUGUCUAAACAUCUCUGG | 1718-1740 |
| AD-240501.1 | 3265 | GUUUAGACAAUUUUAGGCUCA | 1726-1746 | 3561 | UGAGCCUAAAAUUGUCUAAACAU | 1724-1746 |
| AD-240502.1 | 3266 | UUUAGACAAUUUUAGGCUCAA | 1727-1747 | 3562 | UUGAGCCUAAAAUUGUCUAAACA | 1725-1747 |
| AD-240503.1 | 3267 | UUAGACAAUUUUAGGCUCAAA | 1728-1748 | 3563 | UUUGAGCCUAAAAUUGUCUAAAC | 1726-1748 |
| AD-240504.1 | 3268 | UAGACAAUUUUAGGCUCAAAA | 1729-1749 | 3564 | UUUUGAGCCUAAAAUUGUCUAAA | 1727-1749 |
| AD-240505.1 | 3269 | AGACAAUUUUAGGCUCAAAAA | 1730-1750 | 3565 | UUUUUGAGCCUAAAAUUGUCUAA | 1728-1750 |
| AD-240507.1 | 3270 | ACAAUUUUAGGCUCAAAAAUU | 1732-1752 | 3566 | AAUUUUUGAGCCUAAAAUUGUCU | 1730-1752 |
| AD-240512.1 | 3271 | UUUAGGCUCAAAAAUUAAAGA | 1737-1757 | 3567 | UCUUUAAUUUUUGAGCCUAAAAU | 1735-1757 |
| AD-240513.1 | 3272 | UUAGGCUCAAAAAUUAAAGCU | 1738-1758 | 3068 | AGCUUUAAUUUUUGAGCCUAAAA | 1736-1758 |
| AD-240514.1 | 3273 | UAGGCUCAAAAAUUAAAGCUA | 1739-1759 | 3569 | UAGCUUUAAUUUUUGAGCCUAAA | 1737-1759 |
| AD-240538.1 | 3274 | CAGGAAAAGGAACUGUACUGA | 1763-1783 | 3570 | UCAGUACAGUUCCUUUUCCUGUG | 1761-1783 |
| AD-240540.1 | 3275 | GGAAAAGGAACUGUACUGGCU | 1765-1785 | 3571 | AGCCAGUACAGUUCCUUUUCCUG | 1763-1785 |
| AD-240542.1 | 3276 | AAAAGGAACUGUACUGGCUAU | 1767-1787 | 3572 | AUAGCCAGUACAGUUCCUUUUCC | 1765-1787 |
| AD-240545.1 | 3277 | AGGAACUGUACUGGCUAUUAA | 1770-1790 | 3573 | UUAAUAGCCAGUACAGUUCCUUU | 1768-1790 |
| AD-240546.1 | 3278 | GGAACUGUACUGGCUAUUACA | 1771-1791 | 3574 | UGUAAUAGCCAGUACAGUUCCUU | 1769-1791 |
| AD-240779.1 | 3279 | UAAUCCGACUCCCACUACAUA | 2181-2201 | 3575 | UAUGUAGUGGGAGUCGGAUUAUU | 2179-2201 |
| AD-240782.1 | 3280 | UCCGACUCCCACUACAUCAAA | 2184-2204 | 3576 | UUUGAUGUAGUGGGAGUCGGAUU | 2182-2204 |
| AD-240787.1 | 3281 | CUCCCACUACAUCAAGACUAA | 2189-2209 | 3577 | UUAGUCUUGAUGUAGUGGGAGUC | 2187-2209 |
| AD-240788.1 | 3282 | UCCCACUACAUCAAGACUAAU | 2190-2210 | 3578 | AUUAGUCUUGAUGUAGUGGGAGU | 2188-2210 |
| AD-240789.1 | 3283 | CCCACUACAUCAAGACUAAUA | 2191-2211 | 3579 | UAUUAGUCUUGAUGUAGUGGGAG | 2189-2211 |
| AD-240790.1 | 3284 | CCACUACAUCAAGACUAAUCU | 2192-2212 | 3580 | AGAUUAGUCUUGAUGUAGUGGGA | 2190-2212 |
| AD-240792.1 | 3285 | ACUACAUCAAGACUAAUCUUA | 2194-2214 | 3581 | UAAGAUUAGUCUUGAUGUAGUGG | 2192-2214 |
| AD-240793.1 | 3286 | CUACAUCAAGACUAAUCUUGU | 2195-2215 | 3582 | ACAAGAUUAGUCUUGAUGUAGUG | 2193-2215 |
| AD-240794.1 | 3284 | UACAUCAAGACUAAUCUUGUU | 2196-2216 | 3583 | AACAAGAUUAGUCUUGAUGUAGU | 2194-2216 |
| AD-240795.1 | 3288 | ACAUCAAGACUAAUCUUGUUU | 2197-2217 | 3584 | AAACAAGAUUAGUCUUGAUGUAG | 2195-2217 |
| AD-240826.1 | 3289 | GUAUAUAGAAUGCUUUUGCA | 2234-2254 | 3585 | UGCAAAAGCAUUCUAUAUACAU | 2232-2254 |
| AD-240830.1 | 3290 | UAUAGAAUGCUUUUGCAUGGA | 2238-2258 | 3586 | UCCAUGCAAAAGCAUUCUAUAAU | 2236-2258 |
| AD-240833.1 | 3291 | AGAAUGCUUUUGCAUGGACUA | 2241-2261 | 3587 | UAGUCCAUGCAAAAGCAUUCUAU | 2239-2261 |
| AD-240834.1 | 3292 | GAAUGCUUUUGCAUGGACUAU | 2242-2262 | 3588 | AUAGUCCAUGCAAAAGCAUUCUA | 2240-2262 |
| AD-240837.1 | 3293 | UGCUUUUGCAUGGACUAUCCU | 2245-2265 | 3589 | AGGAUAGUCCAUGCAAAAGCAUU | 2243-2265 |
| AD-240839.1 | 3294 | CUUUUGCAUGGACUAUCCUCU | 2247-2267 | 3590 | AGAGGAUAGUCCAUGCAAAAGCA | 2245-2267 |
| AD-240843.1 | 3295 | UGCAUGGACUAUCCUCUUGGU | 2251-2271 | 3591 | AACAAGAGGAUAGUCCAUGCAAA | 2249-2271 |
| AD-240844.1 | 3296 | GCAUGGACUAUCCUCUUGUUU | 2252-2272 | 3592 | AAACAAGAGGAUAGUCCAUGCAA | 2250-2272 |
| AD-240871.1 | 3297 | AAAUAACCUCUUGUAGUUAUA | 2349-2369 | 3593 | UAUAACUACAAGAGGUUAUUUU | 2347-2369 |
| AD-240875.1 | 3298 | AACCUCUUGUAGUUAUAAAAU | 2353-2373 | 3594 | AUUUUAUAACUACAAGAGGUUAU | 2351-2373 |

TABLE 3

HSD17B13 Modified Sequences

| Duplex Name | SEQ ID NO: | Sense Strand Sequence 5' to 3' | SEQ ID NO: | Strand Sequence 5' to 3' |
|---|---|---|---|---|
| AD-238911.1 | 3595 | csasguacCfuCfCfUfcccuaggacuL96 | 3891 | asGfsuccUfaGfGfgaggAfgGfuacugsusc |
| AD-238912.1 | 3596 | asgsuaccUfcCfUfCfcccuaggacuaL96 | 3892 | usAfsgucCfuAfGfgagGfaGfguacusgsu |
| AD-238913.1 | 3597 | gsusaccuCfcUfCfCfcuaggacuaaL96 | 3893 | usUfsaguCfcUfAfgggaGfgAfgguacsusg |
| AD-238929.1 | 3598 | ascsuacaCfaAfGfGfacugaaccaaL96 | 3894 | usUfsgguUfuCfAfguccuUfgUfuaguscsc |
| AD-238930.1 | 3599 | csusacacAfaGfGfAfcugaaccagaL96 | 3895 | usCfsuggUfuCfAfguccUfuGfuguagsusc |
| AD-238932.1 | 3600 | ascsacaaGfgAfCfUfgaaccagaaaL96 | 3896 | usUfsucuGfgUfacaguCfcUfugugusasg |
| AD-238960.1 | 3601 | csasgagcAfaAfGfCfcaugaacauaL96 | 3897 | usAfsuguUfcAfUfggcuUfuGfcucugsusc |
| AD-238979.1 | 3602 | uscsauccUfaGfAfAfauccuucugaL96 | 3898 | usCfsagaAfgGfAfuuucUfaGfgasusg |
| AD-238991.1 | 3603 | uscscuucUfgCfUfUfucgaucaccaL96 | 3899 | usGfsgugAfuCfAfgaagCfaGfaaggasusu |
| AD-239009.1 | 3604 | cscsaucaUfcUfAfCfuccacugaL96 | 3900 | usCfsaagUfaGfGfaguaGfaUfgauggsusg |
| AD-239015.1 | 3605 | uscsuacuCfcUfAfCfuuggagucguL96 | 3901 | asCfsgacUfcCfAfaguaGfgAfguagasusg |
| AD-239016.1 | 3606 | csusacucCfuAfCfUfuggagucguuL96 | 3902 | asAfscgaCfuCfCfaaguAfgGfaguagsasu |
| AD-239017.1 | 3607 | usasucccUfaCfUfUfgggagucguuaL96 | 3903 | asAfsacgAfcUfCfcaagUfaGfgaguasgsg |
| AD-239018.1 | 3608 | ascsuccuAfcUfUfGfgagucguugaL96 | 3904 | usCfsaacGfaCfUfccaaGfuAfggagusasg |
| AD-239019.1 | 3609 | csuscccuaCfuUfGfGfagucguuggaL96 | 3905 | asCfscaaCfgAfCfuccaAfgUfaggagsusa |
| AD-239020.1 | 3610 | uscscuacUfcUfUfGfGfAfgucguuggaL96 | 3906 | usAfsccaAfcGfAfcuccAfaGfuaggasgsu |
| AD-239031.1 | 3611 | gsuscguuGfgUfGfAfaguuuucauL96 | 3907 | asUfsgaaAfaAfCfuucaCfcAfacgacsusc |

TABLE 3-continued

HSD17B13 Modified Sequences

| | | | | |
|---|---|---|---|---|
| AD-239062.1 | 3612 | gsasgauuGfuUfCfUfcauuacuggaL96 | 3908 | usCfscagUfaAfUfgagaAfcAfaucucscsc |
| AD-239066.1 | 3613 | ususguucUfcAfUfUfacuggagcuaL96 | 3909 | usAfsgcuCfcAfCfGfuaauGfaGfaacaasusc |
| AD-239103.1 | 3614 | gscsagacUfaCfUfUfaugaauuugaL96 | 3910 | usCfsaaaUfuCfAfuaagUfaGfucugcscsu |
| AD-239110.1 | 3615 | ascsuuauGfaAfUfUfugcaaaacgaL96 | 3911 | usCfsguuUfuGfCfaaauUfcAfuaagusasg |
| AD-239118.1 | 3616 | asusuugcAfaAfAfCfgacagagcauL96 | 3912 | asUfsgcuCfuGfacguuUfuGfcaaaususc |
| AD-239119.1 | 3617 | ususugcaAfaAfCfGfacagagcauaL96 | 3913 | usAfsugcUfcUfGfucguUfuUfgcaaasusu |
| AD-239131.1 | 3618 | csasgagcAfuAfUfUfgguucugugaL96 | 3914 | usCfsacaGfaAfCfcaauAfuGfcucugsusc |
| AD-239132.1 | 3619 | asgsagcaUfaUfUfGfguucuguggaL96 | 3915 | usCfscacAfgAfAfccaaUfaUfgcucusgsu |
| AD-239133.1 | 3620 | gsasgcauAfuUfUfGfuucuguggaL96 | 3916 | usCfsccaCfaGfAfaccaAfuAfugcucsusg |
| AD-239146.1 | 3621 | csusguggGfaUfAfUfuaauaagcgaL96 | 3917 | usCfsgcuUfaUfUfaauaUfcCfcacagsasa |
| AD-239155.1 | 3622 | asusuaauAfaCfGfCfAfgcguguggaaL96 | 3918 | usUfsccaCfaCfCfgcgcUfuAfuuaausasu |
| AD-239156.1 | 3623 | ususuaauaAfgCfGfCfggguggagaL96 | 3919 | usCfsuccAfcAfCfcgcgCfuUfauuaasusa |
| AD-239177.1 | 3624 | asasacugCfaGfCfUfgagugccgaaL96 | 3920 | usUfscggCfaCfUfcagcUfgCfaguuuscsc |
| AD-239178.1 | 3625 | asascugCfaAfgCfUfGfagugccgaaaL96 | 3921 | usUfsucgGfcAfCfucagCfuGfcaguusuc |
| AD-239179.1 | 3626 | ascsugcaGfcUfGfAfgugccgaaaL96 | 3922 | usUfsuucGfgCfAfcucaGfcUfgcagususu |
| AD-239180.1 | 3627 | csusgcagCfuGfAfGfugccgaaaacL96 | 3923 | gsUfsuuuCfgGfCfcacucAfgCfugcagsusu |
| AD-239181.1 | 3628 | usgscagcUfgAfGfUfgccgaaaacuL96 | 3924 | asGfsuuuUfcGfGfcacuCfaGfcugcasgsu |
| AD-239182.1 | 3629 | gscsagcuGfaGfUfGfccgaaaacuaL96 | 3925 | usAfsguuUfuCfGfgcacUfcAfgcugcsasg |
| AD-239183.1 | 3630 | csasgcugAfgUfGfCfcgaaaacuaaL96 | 3926 | usUfsaguUfuUfCfggcaCfuCfagcugscsa |
| AD-239185.1 | 3631 | gscsugagUfgCfCfGfaaaacuaggaL96 | 3927 | usCfscuaGfuUfUfucggCfaCfucagcsusg |
| AD-239186.1 | 3632 | csusugaguGfcCfGfAfaaacuaggcaL96 | 3928 | usGfsccuAfgUfUfuucgGfcAfcucagscsu |
| AD-239187.1 | 3633 | usgsagugCfcGfAfAfaacuaggcguL96 | 3929 | asCfsgccUfaGfUfuuucGfgCfacucasgsc |
| AD-239188.1 | 3634 | gsasgugcCfgAfAfAfacuaggcguaL96 | 3930 | usAfscgcCfuAfGfuuuuCfgGfcacucsasg |
| AD-239189.1 | 3635 | asgsugccGfaAfAfAfcuaggcgucaL96 | 3931 | usGfsacgCfcUfAfguuuUfcGfgcacuscsa |
| AD-239190.1 | 3636 | gsusgccgAfaAfAfCfuaggcgucaaL96 | 3932 | usUfsgacGfcCfUfaguuUfuCfggcacsusc |
| AD-239191.1 | 3637 | usgsccgaAfaAfCfUfaggcgucacuL96 | 3933 | asGfsugaCfgCfCfuaguUfuUfcggcascsu |
| AD-239192.1 | 3638 | gscscgaaAfaCfUfAfggcgucacuaL96 | 3934 | usAfsgugAfcGfCfcuagUfuUfucggcsasc |
| AD-239193.1 | 3639 | cscsgaaaAfcUfAfGfgcgucacugaL96 | 3935 | usCfsaguGfaCfGfccuaGfuUfuucggscsa |
| AD-239194.1 | 3640 | csgsgaaaaCfuAfGfGfcgucacugcaL96 | 3936 | usGfscagUfgAfCfgccuAfgUfuuucgsgsc |
| AD-239196.1 | 3641 | asasaacuAfgGfCfGfucacugcgaL96 | 3937 | usGfscgcAfgUfGfacgcCfuAfguuuuscsg |
| AD-239198.1 | 3642 | asascuagGfcGfUfCfacugcgcauaL96 | 3938 | usAfsugcGfcAfGfugacGfcCfuaguususu |
| AD-239199.1 | 3643 | ascsuaggCfgUfCfAfcugcgcaugaL96 | 3939 | usCfsaugCfgCfAfguagCfgCfcuagususu |
| AD-239203.1 | 3644 | gsgscgucAfcCfUfCfgcaugcguauL96 | 3940 | asUfsacgCfaUfGfcgcaGfuGfacgccsusa |
| AD-239214.1 | 3645 | gscsaugcGfuAfUfGffugguagacuaL96 | 3941 | usAfsgucUfaCfCfacauAfcGfcaugcsgsc |
| AD-239215.1 | 3646 | csasaugcGfuAfUfGfUfgguagacugaL96 | 3942 | usCfsaguCfuAfCfcacaUfaCfgcaugscsg |
| AD-239239.1 | 3647 | asascagaGfaAfGfAfgaucuaucgcuL96 | 3943 | usCfsgauAfgAfUfcucuUfcUfcuguusgsc |
| AD-239240.1 | 3648 | ascsagagAfaGfAfGffaucuaucgcuL96 | 3944 | asGfscgaUfaGfAfucucUfuCfucugususg |
| AD-239241.1 | 3649 | csasgagaAfgAfGfAfucuaucgcuaL96 | 3945 | usAfsgcgAfuAfGfaucuCfuUfcucugsusu |
| AD-239242.1 | 3650 | asgsagaaGfaGfAfUfcuaucgcucuL96 | 3946 | asGfsagcGfaUfAfgaucUfcUfucucusgsu |
| AD-239243.1 | 3651 | gsasgaagAfgAfUfCfuaucgcucuaL96 | 3947 | usAfsgagCfgAfUfaganCfuCfuuucscsusg |
| AD-239245.1 | 3652 | gsasagagAfuCfUfAfaucgcucucuL96 | 3948 | asAfsgagAfgCfGffauagAfuCfucucscsusc |
| AD-239246.1 | 3653 | asasgagaUfcUfAfUfcgcucucuaaL96 | 3949 | usUfsagaGfaGfCfgauaGfaUfcucuuscsu |
| AD-239247.1 | 3654 | asgsagauCfuAfUfCfgcucucuaaaL96 | 3950 | usUfsuagAfgAfGfcgauAfgAfucucusasc |
| AD-239250.1 | 3655 | gsasucuaUfcGfCfUfcucuaaaucaL96 | 3951 | usGfsauuUfaGfAfgagcGfaUfagaucsusc |
| AD-239251.1 | 3656 | asuscuauCfgCfUfCfucuaaaaucaL96 | 3952 | usUfsgauUfuaAfGfagagCfgAfuagauscsu |
| AD-239253.1 | 3657 | csususcgCfuCfUfCfuaaaaucagguL96 | 3953 | asCfscugAfuUfUfagagAfgCfgauagsasu |
| AD-239254.1 | 3658 | usasucgcUfcUfCfUffaaaaucagguaL96 | 3954 | usAfsccuGfaUfUfuagaGfaGfcgauasgsa |
| AD-239255.1 | 3659 | asuscgcuCfuCfUfAfaaaaucaggasgL96 | 3955 | usCfsaccUfgGfAffuuagAfgAfgcgauasg |
| AD-239290.1 | 3660 | gsasuguaAfcCfAfAfCfgcguggaauL96 | 3956 | asUfsucaCfcAfCfgauuGfuUfacaucssac |
| AD-239291.1 | 3661 | asusuguaaCfaAfUfCfguggugaauaL96 | 3957 | usAfsuucAfcCfAfcgauUfgUfuacauscsa |
| AD-239292.1 | 3662 | usgsuuaacAfaUfCfGfuggugaauaaL96 | 3958 | usUfsauuCfaCfCfacgaUfuGfuuacasusc |
| AD-239293.1 | 3663 | ususaacaAfuCfGfUfggugaauaauL96 | 3959 | asUfsuauUfcAfCfcacgAfuUfguuacsasu |
| AD-239304.1 | 3664 | gsgsguaaUfaAfUfGfGfcugggacaguL96 | 3960 | asCfsuguCfcCfAfgcauUfaUfucaccsasc |
| AD-239312.1 | 3665 | asusgcugGfgAfCfAfguauauccaaL96 | 3961 | usUfsggaUfaUfAfcuguCfcCfagcausus |
| AD-239313.1 | 3666 | usgscuggGfaCfAfGfuauauccagaL96 | 3962 | usCfsuggAfuAfUfacugUfcCfcagcasusu |
| AD-239314.1 | 3667 | gscsugggAfcAfGfUfauauccagcaL96 | 3963 | usGfscugGfaUfAfuacuGfuCfccagcsasa |
| AD-239316.1 | 3668 | usgsggacAfgUfAfUfauccagccgaL96 | 3964 | usCfsggcUfgGfAfuauaCfuGfucccasgsc |
| AD-239317.1 | 3669 | gsgsgacaGfuAfUfAfuccagccgauL96 | 3965 | asUfscggCfuGfGfauauAfcUfgucccasg |
| AD-239318.1 | 3670 | gsgsgacaGfuAfUfAfUfuccagccgauaL96 | 3966 | usAfsucgGfcUfGfgauaUfaCfugucsscsa |
| AD-239321.1 | 3671 | csasguauAfuCfCfAfgccgaucuuaL96 | 3967 | usAfsagaUfcGfGfcuggAfuAfuacugsusc |
| AD-239332.1 | 3672 | cscsgauCfuCfUfUfcagcaccaaaL96 | 3968 | usUfsuggUfgCfUfgagaAfgAfucugscsusg |
| AD-239337.1 | 3673 | uscsuucuCfaGfCfAfccaaggaugaL96 | 3969 | usCfsauCfuUfGfgugcUfgAfgaagasusc |
| AD-239348.1 | 3674 | cscsaaggAfuGfAfAfgaganuaccaL96 | 3970 | usGfsguaAfuCfUfcuucAfuCfcuuggsusg |
| AD-239362.1 | 3675 | asusuaccAfaAfAfCfauuugggaL96 | 3971 | usAfscccCfaAfAfugucUfuUfgfuaausscu |
| AD-239366.1 | 3676 | cscsaagaCfaUfUfUfggggucaacaL96 | 3972 | usGfsuugAfcCfCfcaaaUfgUfcuuggssua |
| AD-239368.1 | 3677 | asasgacaUfuUfGfAfggucaacauaL96 | 3973 | usAfsuguUfgAfCfcucaAfaUfgucuusgsg |
| AD-239372.1 | 3678 | csasuuugAfgGfUfCffaacauccuaaL96 | 3974 | usUfsaggAfuGfUfugacCfuCfaaaugssuc |
| AD-239373.1 | 3679 | asusuugaGfgUfCfAfacauccuagaL96 | 3975 | usCfsuagGfaUfGfuugaCfcUfcaaausgsu |
| AD-239379.1 | 3680 | gsgsucaaCfaUfCfCfuaggacauuuL96 | 3976 | asAfsaugUfcCfUfaggaUfgUfugaccssuc |
| AD-239380.1 | 3681 | gsuscaacAfuCfCfUfaggacauuuuL96 | 3977 | asAfsaauUfcCfCfuaggAfuGfuugacsscsu |
| AD-239387.1 | 3682 | uscscuagGfaCfAfuuuuggaucaL96 | 3978 | usGfsaucCfaAfAfaauGfcCfuaggasusg |
| AD-239397.1 | 3683 | ususuuugGfaUfCfAfcaaaagcacuL96 | 3979 | asGfsugcUfuUfUfgugaUfcCfaaaasusg |
| AD-239411.1 | 3684 | asasgcacUfuCfUfUfCfccaucgaugaL96 | 3980 | usCfsaucGfaUfGfggaaGfaAfgugcususu |
| AD-239412.1 | 3685 | asgscacuUfcUfUfCfcaucgaugaL96 | 3981 | asUfsucaUfcGfAfUfggaaGfaAfgugcususu |
| AD-239431.1 | 3686 | asusggagAfgAfAfAfucaugccaaL96 | 3982 | usUfsggcCfaUfGfauuCfuCfuccaasscsa |
| AD-239433.1 | 3687 | gsgsagagAfaAfAfUfCfauggccacauL96 | 3983 | asUfsgugGfcCfAfugauUffuCfucuccsasu |
| AD-239436.1 | 3688 | gsasgaaaUfcAfUfGfgccacaucguL96 | 3984 | asCfsgauGfuGfGfccauGfaUfuucuscsusc |
| AD-239437.1 | 3689 | asgsaaauCfaUfGfGfccacaucguaL96 | 3985 | usAfscgaUfgUfGfgccaUfgAfuuucusscsc |

TABLE 3-continued

HSD17B13 Modified Sequences

| | | | | |
|---|---|---|---|---|
| AD-239438.1 | 3690 | gsasaaucAfuGfGfCfcacaucgucaL96 | 3986 | usGfsacgAfuGfUfggccAfuGfauuucsusc |
| AD-239439.1 | 3691 | asasaucaUfgGfCfCfacaucgucaaL96 | 3987 | usUfsgacGfaUfGfuggcCfaUfgauuuscsu |
| AD-239450.1 | 3692 | ascsaucgUfcAfCfAfguggcuucapL96 | 3988 | usUfsgaaGfcCfAfcuguGfaCfgaugusgsg |
| AD-239451.1 | 3693 | csasucguCfaCfAfGfuggcuucaguL96 | 3989 | asCfsugaAfgCfCfacugUfgAfcgaugsusg |
| AD-239452.1 | 3694 | asuscgucAfcAfAfUfggcuucaguaL96 | 3990 | usAfscugAfaGfCfcacuGfuGfacgausgsu |
| AD-239453.1 | 3695 | uscsgucaCfaGfUfGfgcuucaguguL96 | 3991 | asCfsacuGfaAfGfccacUfgUfgacgasusg |
| AD-239475.1 | 3696 | csgsgccaCfgAfAfGfggauucuuaL96 | 3992 | usAfsaggAfaUfCfccuuCfgUfggccgscsa |
| AD-239476.1 | 3697 | gsgsccacGfaAfGfGfgauuccuuaL96 | 3993 | usUfsaagGfaAfUfcccuUfcGfuggccsgsc |
| AD-239478.1 | 3698 | cscsacgaAfgGfGfAfuuccuuaccuL96 | 3994 | asGfsguaAfgGfAfauccCfuUfcguggscsc |
| AD-239479.1 | 3699 | csascgaaGfgGfAfUfuccuuaccuaL96 | 3995 | usAfsgguAfaGfGfaaucCfcUfucgugsgsc |
| AD-239480.1 | 3700 | ascsgaagGfgAfUfUfccuuaccucaL96 | 3996 | usAfsaggUfaAfGfgaauCfcCfuucgusgsg |
| AD-239482.1 | 3701 | gsasagggAfuUTCfCfuuaccucauaL96 | 3997 | usAfsugaGfgUfAfaggaAfuCfccuucsgsu |
| AD-239483.1 | 3702 | asasgggaUfuCfCfUfuaccucaucaL96 | 3998 | usGfsaugAfgGfUfaaggAfaUfcccuuscsg |
| AD-239499.1 | 3703 | csasucccAfuAfUfUfguuccagcaaL96 | 3999 | usUfsgcuGfgAfAfcaauAfuGfggaugsasg |
| AD-239510.1 | 3704 | gsusuccaGfcAfAfAfuuugccgcuaL96 | 4000 | usAfsgcgGfcAfAfauuuGfcUfggaacsasa |
| AD-239520.1 | 3705 | asusuugcCfgCfCfUfGfuuggcuuucaL96 | 4001 | usGfsaaaGfcCfAfacagCfgGfcaaausustu |
| AD-239521.1 | 3706 | ususugccGfcUfGfUfuggcuuucaaL96 | 4002 | usUfsgaaAfgCfCfaacaGfcGfcaaausustu |
| AD-239522.1 | 3707 | ususgccgCfuGfUfUfggcuuucacaL96 | 4003 | usGfsugaAfaGfCfcaacAfgCfggcaasasu |
| AD-239534.1 | 3708 | gcsuuucAfcAfGfAfggucugacauL96 | 4004 | asUfsgucAfgAfCfcucuGfuGfaaagcscsa |
| AD-239539.1 | 3709 | csascagaGfgUfCfUfgacaucagauL96 | 4005 | usUfscugAfuGfacagaCfcUfeugugsasa |
| AD-239544.1 | 3710 | asgsgucuGfaCfAfUfcagaacuucaL96 | 4006 | usGfsaagUfuCfUfgaugUfcAfgaccuscsu |
| AD-239566.1 | 3711 | gscscuugGfgAfAfAfaacuggauauL96 | 4007 | usAfsuacCfaGfUfuuuuCfcCfaaggcscsu |
| AD-239578.1 | 3712 | ascsugguAfuCfAfAfaccucauguL96 | 4008 | asCfsaugAfgGfUfuuugAfuAfcagususu |
| AD-239579.1 | 3713 | csusgguaUfcAfAfAfaccucauguaL96 | 4009 | usAfscauGfaGfGfuuuuGfaUfaccagsusu |
| AD-239611.1 | 3714 | ususugugAfaUfAfCfuggguucacaL96 | 4010 | usGfsugaAfcCfCfaguaUfuCfacaasasa |
| AD-239612.1 | 3715 | ususgugaAfuAfCfUfgggvuucaccaL96 | 4011 | usGfsgugAfaCfCfcaguAfuUfcacaasasa |
| AD-239613.1 | 3716 | usgsugaaUfaCfUfGfggvuucaccaaL96 | 4012 | usUfsgguGfaAfCfccagUfaUfucacasasa |
| AD-239617.1 | 3717 | asasuacuGfgGfUfUfcaccaaaaauL96 | 4013 | asUfsuuuUfgGfGfgaacCfcAfguauuscsa |
| AD-239618.1 | 3718 | asusuacugGfgUfUfcaccaaaaauaL96 | 4014 | usAfsuuuUfuGfGfugaaCfcCfaguauususc |
| AD-239637.1 | 3719 | uscscaagCfaCfAfAfgauuauggcaL96 | 4015 | usGfsccaUfaAfUfcuugUfgCfuggasusu |
| AD-239641.1 | 3720 | asgscacaAfgAfUfUfauggccuguaL96 | 4016 | usAfscagGfcCfAfuaauCfuUfgugcususg |
| AD-239642.1 | 3721 | gscsacaaGfaUfUfAfuggccuguauL96 | 4017 | asUfsacaGfgCfCfauaaUfcUfugugcsusu |
| AD-239643.1 | 3722 | csascaagAfuUfAfUfggccuguauuL96 | 4018 | asAfsuacAfgGfCfcauaAfuCfuugugscsu |
| AD-239645.1 | 3723 | csasagauUfaUfGfGfccuguaugaL96 | 4019 | usCfsaauAfcAfGfgccaUfaAfucugsusg |
| AD-239647.1 | 3724 | asgsauuaUfgGfCfCfuguauuggaaL96 | 4020 | usUfsccaAfuAfCfaggcCfaUfaaucususg |
| AD-239649.1 | 3725 | asusuaugGfcCfUfGfuauuggagaaL96 | 4021 | usUfscucCfaAfUfacagGfcCfauaauscsu |
| AD-239650.1 | 3726 | ususauggCfcUfGfUfauuggagacaL96 | 4022 | usGfsucuCfcAfAfuacaGfgCfcauaasusc |
| AD-239653.1 | 3727 | usgsgccuGfuAfUfUfgggagacagauL96 | 4023 | asUfscugUfcUfCfcaauAfcAfggccasusa |
| AD-239654.1 | 3728 | gsgsccugUfaUfUfGfgagacagauaL96 | 4024 | usAfsucuGfuCfUfccaaUfaCfaggccsasu |
| AD-239662.1 | 3729 | ususggagAfcAfGfAfugaagucguaL96 | 4025 | usAfscgaCffuUfCfaucuGfuCfuccaasasa |
| AD-239668.1 | 3730 | ascsagauGfaAfGfUfcguaagaaguL96 | 4026 | asCfsuucUffuAfCfgacuUfcAfucugusc |
| AD-239669.1 | 3731 | csasgaugAfaGfUfCfguaagaaguaL96 | 4027 | usAfscuuCfuUfAfcgacUfuCfaucugsusc |
| AD-239670.1 | 3732 | asgsaugaAfgUfCfGfuaagaagucuL96 | 4028 | asGfsacuUfcUfUfacgaCfuUfcaucusgsu |
| AD-239671.1 | 3733 | gsasugaaGfuCfUfGfaagaagucuaL96 | 4029 | usAfsgacUfuCfUfuacgAfcUfucaucsusg |
| AD-239674.1 | 3734 | gsasagucGfuAfAfGfAfaagucuauaL96 | 4030 | usAfsucaGfaCfCfucuuAfcGfacuucsasu |
| AD-239676.1 | 3735 | asgsucguAfaGfAfAfgucugauagaL96 | 4031 | usCfsuauCfaGfAfcuucUfuAfcgacususc |
| AD-239681.1 | 3736 | usasagaaGfuCfUfGfauuagauggaaL96 | 4032 | usUfsccaUfcUfAfucagAfcUfucuuascsg |
| AD-239682.1 | 3737 | asgsaagUfcUfGfAfuagaugagaatL96 | 4033 | asUfsuccAfuCfUfaucaGfaCfuucuusasc |
| AD-239684.1 | 3738 | gsasagucUfgAfUfAfgauggaauaaL96 | 4034 | usUfsauuCfcAfUfcuauCfaGfacuucsusu |
| AD-239685.1 | 3739 | asasgucuGfaUfAfGfauggaauacuL96 | 4035 | asGfsuauUfcCfAfucuaUfcAfgacuuscsu |
| AD-239697.1 | 3740 | usgsgaauAfcUfUfAfccaauaagaaL96 | 4036 | usUfscuuAfuUfGfgaaGfuAfuuccasusc |
| AD-239713.1 | 3741 | asasugauUfuUfUfGfuuccaucguaL96 | 4037 | usAfscgaUfgGfAfacaaAfaAfucausust |
| AD-239714.1 | 3742 | asusgauuUfuUfGfUfuccaucguauL96 | 4038 | asUfsacgAfuGfGfaacaAfaAfaucausust |
| AD-239717.1 | 3743 | asusuuuuGfuUfcCfCfaucguauauaL96 | 4039 | usAfsuauAfcGfAfuggaAfcAfaaauscsa |
| AD-239721.1 | 3744 | ususguucCfaUfCfGfuauaucaauaL96 | 4040 | usAfsuugAfuAfUfacgaUfgGfaacaasasa |
| AD-239723.1 | 3745 | gsusuccaUfcGfUfAfuaucaauauaL96 | 4041 | usAfsuauUfgAfUfauacGfaUfggaacsasa |
| AD-239724.1 | 3746 | ususcccauCfgUfAfUfaucaauauccuL96 | 4042 | asGfsauaAffuUfAfuauaCfgAfuggaascsa |
| AD-239725.1 | 3747 | uscscaucGfuAfUfAfucaauauccuL96 | 4043 | asAfsgauAfuUfAfuauaAfcGfauggasasc |
| AD-239726.1 | 3748 | cscsaucgUfaUfAfUfcaauauccuuL96 | 4044 | asAfsagaUfaUfUfgauaUfaCfgauggsasa |
| AD-239755.1 | 3749 | ascsagaaGfuUfUfCfuccccugaacaL96 | 4045 | usGfsuucAfgGfAfagaaAfcUfucugusasg |
| AD-239757.1 | 3750 | gsgsaaguUfuCfUfCfccugaacgcaL96 | 4046 | usGfscguUfcAfGfGfaagAfaAfcuucusgsu |
| AD-239759.1 | 3751 | asasguuuCfuUfCfCfugaacgcgcaL96 | 4047 | usGfscgcGfuUfCfaggaAfgAfaacuuscsu |
| AD-239761.1 | 3752 | gsusuucuUfcCfUfGfaacgcgccaL96 | 4048 | usAfsggcGfcGfUfucagGfaAfgaaacsusu |
| AD-239764.1 | 3753 | uscsuuccUfgAfAfCfgcgccacagaL96 | 4049 | usCfsugaGfgCfGfcguuCfaGfgaagasasa |
| AD-239778.1 | 3754 | cscsucagCffgAfUfUfuuaaaucguaL96 | 4050 | usAfscguUfuUfAfaaauCfgCfugagsgscsg |
| AD-239779.1 | 3755 | csuscagcGfaUfUfUfuaaaucguauL96 | 4051 | asUfsacgAfuUfUfaaaaUfcGfcugagsgsc |
| AD-239780.1 | 3756 | uscsagcgAfuUfUfUfaaaucguauaL96 | 4052 | usAfsuacGfaUfUfuaaaAfuCfgcugasgsg |
| AD-239781.1 | 3757 | csasgcgaUfuUfUfAfaaucguaugaL96 | 4053 | usCfsauaCfgAfUfuuaaAfaUfcgcugsasg |
| AD-239782.1 | 3758 | asgscgauUfuUfAfAfaucguaugcaL96 | 4054 | usGfscauAfcGfAfuuuuAfaAfucgcugsga |
| AD-239783.1 | 3759 | gscsgauuUfuAfAfAfaucguaugcaL96 | 4055 | usUfsgcaUfaCfGffauuu.AfaAfaucgcsusg |
| AD-239784.1 | 3760 | csgsauuuUfaAfAfUfcguaugcaaL96 | 4056 | usCfsugcAfuAfCfgauuUfaAfaaucgscsu |
| AD-239785.1 | 3761 | gsasuuuuAfaAfUfCfguaugcaaaL96 | 4057 | usUfscugCffaUfAfcgauUfuAfaaaucsgsc |
| AD-239786.1 | 3762 | asusuuuAfaUfCfGfuaugcagaauL96 | 4058 | asUfsucuCffgCfAfucgaUfuUfaaaauscsg |
| AD-239787.1 | 3763 | ususuuaaAfuCfGfuUfaugcagaauaL96 | 4059 | usAfsuucUfgCfAfuacgAfuUfaaaasusc |
| AD-239791.1 | 3764 | asasaucgUfaUfGfCffagaauauucaL96 | 4060 | usGfsaauAfuUfCfgcaUfaCfgauuusasa |
| AD-239793.1 | 3765 | asuscguaUfgCfAfGfaauauucaauL96 | 4061 | asUfsugaAfuAfUfucugCfaUfacgaususu |
| AD-239806.1 | 3766 | usasuucaAfuUfUfGfaagcagguL96 | 4062 | asCfscacUfgCfUfcaaAfuUfgaauasusu |
| AD-239839.1 | 3767 | gsasauaaAfuAfAfAfgfuccagccaaL96 | 4063 | usUfsggcUfgGfAfgcuuAfuUfuauucsasu |

TABLE 3-continued

HSD17B13 Modified Sequences

| | | | | |
|---|---|---|---|---|
| AD-239840.1 | 3768 | asasuaaaUfaAfGfCfuccagccagaL96 | 4064 | usCfsuggCfuGfGfagcuUfaUfuuauuscsa |
| AD-239854.1 | 3769 | asgsccagAfgAfUfGfuaugcaugauL96 | 4065 | asUfscauGfcAfUfacauCfuCfuggcusgsg |
| AD-239855.1 | 3770 | gscscagaGfaUfGfUfaugcaugauaL96 | 4066 | usAfsucaUfgCfAfuacaUfcUfcuggcsusg |
| AD-239876.1 | 3771 | asusaugaAfuAfGfUfuucgaaucaaL96 | 4067 | usUfsgauUfcGfAfacuAfuUfcauauscsa |
| AD-239877.1 | 3772 | usasugaaUfaGfUfUfucgaaucaauL96 | 4068 | asUfsugaUfuCfGfaaacUfaUfucauasusc |
| AD-239881.1 | 3773 | asasuaguUfuCfGfAfaucaaugcuaL96 | 4069 | usAfsgcaUfuGfAfuucgAfaAfcuauuscsa |
| AD-239905.1 | 3774 | ususcaguCfcUfGfAfuaauauuaaaL96 | 4070 | usUfsuaaUfaUfUfaucaGfgAfcugaasasa |
| AD-239914.1 | 3775 | asasaaacAfuUfGfGfuuuggcacuaL96 | 4071 | usAfsgugCfcAfAfaccaAfuGfuuuusasa |
| AD-239915.1 | 3776 | asasaacaUfuGfGfUfuuggcacuaaL96 | 4072 | usUfsaguGfcCfAfaaccAfaUfguuuususa |
| AD-239941.1 | 3777 | gsuscaaaCfgAfAfCfaagauuaauuL96 | 4073 | asAfsuuaAfuCfUfuguuCfgUfuugacsusg |
| AD-239944.1 | 3778 | asasacgaAfcAfAfGfauuaauuacaL96 | 4074 | usUfsuaaUfuAfAfucuuGfuUfcguuusgsa |
| AD-239945.1 | 3779 | asascgaaCfaAfGfAfuuaauuaccuL96 | 4075 | asGfsguaAfuUfAfaucuUfgUfucguususg |
| AD-239946.1 | 3780 | ascsgaacAfaGfAfUfuaauuaccuaL96 | 4076 | usAfsgguAfaUfUfaaucUfuGfuucgususu |
| AD-239947.1 | 3781 | csgsaacaAfgAfUfUfaauuaccuguL96 | 4077 | asCfsaggUfaAfUfuaauCfuUfguucgsusu |
| AD-239977.1 | 3782 | uscsucaaGfcAfUfAfuuuacguaguL96 | 4078 | asCfsuacGfuAfAfauauUfcUfugagasna |
| AD-239979.1 | 3783 | uscsaagaAfuAfUfUfuacguaguuuL96 | 4079 | asAfsacuAfcGfUfaaauAfuUfcuugasgsa |
| AD-239980.1 | 3784 | csasagaaUfaUfUfUfacguaguuuuL96 | 4080 | asAfsaacUfaCfGfuaaaUfaUfucuugsasg |
| AD-239998.1 | 3785 | ususucauAfgGfUfCfuguuuuuccuL96 | 4081 | asGfsgaaAfaAfCfagacCfuAfugaaasasa |
| AD-240019.1 | 3786 | ususcaugCfcUfCfUfuaaaaacuuaL96 | 4082 | usAfsaguUfuUfUfaagaGfgCfaugaasasg |
| AD-240031.1 | 3787 | asasaaacUfuCfUfGfugcuuacauaL96 | 4083 | usAfsuguAfaGfCfacagAfaGfuuuusasa |
| AD-240032.1 | 3788 | asasaacuUfcUfGfUfgcuuacauaaL96 | 4084 | usUfsaugUfaAfGfcacaGfaAfguuuususa |
| AD-240033.1 | 3789 | asasacuuCfuGfUfGfcuuacauaaL96 | 4085 | usUfsuauGfuAfAfgcacAfgAfaguuususu |
| AD-240064.1 | 3790 | ususuuucCfaUfUfUfaaaggugaaL96 | 4086 | usUfsccaCfcUfUfuaaaUfgGfaaaaasusa |
| AD-240090.1 | 3791 | csusaccuCfcCfUfAfaaaguaaauaL96 | 4087 | usAfsuuuAfcUfUfuuagGfgAfgguagscsu |
| AD-240091.1 | 3792 | usasccucCfcUfAfAfaaguaaauaL96 | 4088 | usUfsauuUfaCfUfuuuaGfgGfagguasgsc |
| AD-240108.1 | 3793 | usascaaaGfaGfAfAfcuuauuuacaL96 | 4089 | usGfsuaaAfuAfAfguucUfcUfuuguasusu |
| AD-240117.1 | 3794 | asascuuaUfuAfUfAfCfacagggaagaL96 | 4090 | usCfsuucCfcUfGfguaAfaUfaaguuscsu |
| AD-240124.1 | 3795 | ususacacAfgGfGfAfagguuuaagaL96 | 4091 | usCfsuuaAfaCfCfuuccCfuGfguaaasasu |
| AD-240125.1 | 3796 | usascacaGfgGfAfAfgguuuaagaL96 | 4092 | usUfscuuAfaAfCfcuucCfcUfguguasasa |
| AD-240126.1 | 3797 | ascsacagGfgAfAfGfguuuaagacuL96 | 4093 | asGfsucuUfaAfAfccuuCfcCfugugusasa |
| AD-240135.1 | 3798 | asgsguuuAfaAfAfCfuguccaaguaL96 | 4094 | usAfscuuGffAfAfCfagucUfuAfaaccusuc |
| AD-240138.1 | 3799 | ususuaagAfcUfGfUfucaaguagcaL96 | 4095 | usGfscuaCfuUfGfaacaGfuCfuuaaascsc |
| AD-240140.1 | 3800 | usasagacUfgUfUfCfaaguagcauuL96 | 4096 | asAfsugcUfaCfUfugaaCfaGfucuuasasa |
| AD-240142.1 | 3801 | asggsacugUfuCfAfAfguagcauucaL96 | 4097 | usGfsaauGfcUfAfcuugAfaCfagucususa |
| AD-240145.1 | 3802 | csusguucAfaAfUfAfgcauuccaauL96 | 4098 | asUfsuggAfaUfGfcuacUfuUfgaacagsusc |
| AD-240147.1 | 3803 | gsususcaaGfuAfUfGfCfauuccaaucuL96 | 4099 | asGfsauuGfgAfAfugcuAfcUfugaacsasg |
| AD-240148.1 | 3804 | ususcaagUfaGfCfAfuuccaaucaL96 | 4100 | usAfsgauUfgGfAfaugcUfaCfuugaascsa |
| AD-240154.1 | 3805 | usasgcauUfcCfAfAfucuguagccaL96 | 4101 | usGfsgcuAfcAfAfuugGfaAfugcuascsu |
| AD-240155.1 | 3806 | asgscauuCfcAfAfUfcuguagccauL96 | 4102 | asUfsggcUfaCfAfgauuGfgAfaugcusasc |
| AD-240156.1 | 3807 | gscsauucCfaAfUfCfuguagccauaL96 | 4103 | asAfsuggCfuAfCfagauUfgAfaugcsusa |
| AD-240171.1 | 3808 | gscscaugCfcAfCfAfgaauaucaaaL96 | 4104 | usUfsugaUfaUfUfcuguGfgCfauggcsusa |
| AD-240172.1 | 3809 | cscscaugCfaCfAfGfaauaucaacaL96 | 4105 | usGfsuugAfuAfUfucugUfgGfcauggscsu |
| AD-240192.1 | 3810 | asasgaacAfcAfGfAfaugaugcaaaL96 | 4106 | usUfsgcaCfuCfAfuucuGfuGfuucuusgsu |
| AD-240227.1 | 3811 | gsusuucaGfcAfGfGfcagcuuuauaL96 | 4107 | usAfsuaaAfgCfUfgccuGfcUfgaaacsusu |
| AD-240228.1 | 3812 | ususucagCfaGfGfCffagcuuuaucuL96 | 4108 | asGfsauaAfaAfGfCfugccUfgCfugaaascsu |
| AD-240237.1 | 3813 | gscsagcuUfuAfUfCfucaaccuggaL96 | 4109 | usCfscagGfuUfGfagauAfaAfgcugcscsu |
| AD-240245.1 | 3814 | asuscucaAfcCfUfGfacauauuuuL96 | 4110 | asAfsaauAfuUfGfccagGfuUfgagausasa |
| AD-240276.1 | 3815 | asusuugaAfaAfUfAfuuccuagcaL96 | 4111 | usGfscuaGffAfAfaucUfuUfcaaausgsc |
| AD-240278.1 | 3816 | ususgaaaGfaUfUfUfcccuagccuaL96 | 4112 | usAfsgggCfUfaGfGfgaaaUfcUfuucaasasu |
| AD-240279.1 | 3817 | usgsaaagAfuUfUfCfccuagccucuL96 | 4113 | asGfsaggCfuAfGfgaaAfuCfuuucasasa |
| AD-240280.1 | 3818 | gsasaagaUfuUfCfCfcuagccucuuL96 | 4114 | asAfsgagGfcUfAfgggaAfaUfcuuucsasa |
| AD-240308.1 | 3819 | csasuuagCfcCfAfAfaacgguggcaaL96 | 4115 | usUfsgccaCffcGfUfuuugGfgCfuaaugsga |
| AD-240309.1 | 3820 | asusuagcCfcAfAfAfacggugcaaaL96 | 4116 | usUfsugcAfcCfGfuuuuGfgGfcuaausgsa |
| AD-240310.1 | 3821 | ususagccCfaAfAfAfcggugcaacuL96 | 4117 | asGfsuugCfaCfCfguuuUfgGfgcuaasusg |
| AD-240311.1 | 3822 | usasgcccAfaAfAfCfggugcaacuaL96 | 4118 | usAfsguuGfcAfCfgfuuUfuGfggcuasasu |
| AD-240312.1 | 3823 | asgscccaAfaAfCfGfgugcaacucaL96 | 4119 | asGfsaguUfgCfAfccguUfuUfgggcusasa |
| AD-240313.1 | 3824 | cscsccaaAfaCfGfGfugcaacucuaL96 | 4120 | usAfsgagUfuGfCfaccgUffuUfugggcsusa |
| AD-240315.1 | 3825 | cscsaaaaCfgGfUfGfcaacucuauL96 | 4121 | asAfsuagAfgUfUfgcacCfgUfuuuggsgsc |
| AD-240317.1 | 3826 | asasaacgGfuGfCfAfacucuauucuL96 | 4122 | asGfsaauAfgAfGfuugcAfcCfguuusgsg |
| AD-240318.1 | 3827 | asasacggUfgCfAfAfcucuauucuaL96 | 4123 | usAfsgaaUfaGfAfguugCfaCfcguuusug |
| AD-240319.1 | 3828 | asascgguGfcAfAfCfucuauucguaL96 | 4124 | usCfsagaAfuAfGfaguuGfcAfccguususu |
| AD-240322.1 | 3829 | gsgsugcaAfcUfCfUfauucuggacuL96 | 4125 | usGfsuccAfgAfAfuagaGfuUfgcaccsgsu |
| AD-240324.1 | 3830 | usgscaacUfcUfAfUfucuggacuuuL96 | 4126 | asAfsaguCfcAfGfaauaGfaGfuugcascsc |
| AD-240326.1 | 3831 | csasacucUfaUfUfCfuggacuuuauL96 | 4127 | asUfsaaaGfuCfCfagaaUfaGfaguugscsa |
| AD-240327.1 | 3832 | asUfscucuAfuUfCfUfggacuuuauuL96 | 4128 | asAfsuaaAfgUfCfcagaAfuAfgaguusgsc |
| AD-240333.1 | 3833 | asusucugGfaCfUfUfuauuacuugaL96 | 4129 | usCfsaagUfaAfUfaaagUfcCfagaausasg |
| AD-240364.1 | 3834 | usgsuauaAfcUfCfUfgaaguccacaL96 | 4130 | usGfsuggAfcUfUfcagaGfuUfauacasgsa |
| AD-240365.1 | 3835 | gsusauaaCfuUfUfGfaaguccacaL96 | 4131 | usGfsgugGfaCfUfucagAfgUfuauacsasg |
| AD-240375.1 | 3836 | gsasagucCfaCffCfAfaaaguggacaL96 | 4132 | usGfsuccAfcUfUfuuggUfgGfacuucsasg |
| AD-240378.1 | 3837 | gsusccacCfaAfAfAfguggaccuaL96 | 4133 | usAfsgggUfcCfAfcuuuUfgGfuggacsusu |
| AD-240381.1 | 3838 | csasccaaAfaGfUfGfgacccucuauL96 | 4134 | asUfsagaGfgGfUfccacUffuUfugsgsa |
| AD-240382.1 | 3839 | ascscaaaAfgUfGfGfacccucuauaL96 | 4135 | usAfsuagAfgGfGfuccaCfuUfugsgsg |
| AD-240383.1 | 3840 | cscsaaaaGfuGfGfAfcccucuauauL96 | 4136 | asUfsauaGfaGfGfguccAfcUfuuugsgsa |
| AD-240385.1 | 3841 | asasaaguGfgAfCfCfcucuauauuuL96 | 4137 | asAfsauaUfaGfAfggguCfcAfcuuusgsg |
| AD-240386.1 | 3842 | asasagugGfaCfCfCfucuauauuuL96 | 4138 | usAfsaauAfuAfAfgggUfcCfacuuusug |
| AD-240387.1 | 3843 | asasagugGfaCfCfCfucuauauucaL96 | 4139 | usGfsaaaUfaUfAfgaggUfcCfacuususu |
| AD-240419.1 | 3844 | asusacauUfaUfGfAfaaggugaccaL96 | 4140 | usGfsgucAfcCfUfuucaUfaAfuguauscsu |
| AD-240420.1 | 3845 | usascauuAfuUfGfAfAfaggugaccgaL96 | 4141 | usCfsgguCfaCfCfuuucAfuAfauguasusc |

TABLE 3-continued

HSD17B13 Modified Sequences

| | | | | |
|---|---|---|---|---|
| AD-240421.1 | 3846 | ascsauuaUfgAfAfggugaccgaaL96 | 4142 | usUfscggUfcAfCfcuuuCfaUfaaugusasu |
| AD-240422.1 | 3847 | csasuuauGfaAfGfgugaccgacuL96 | 4143 | asGfsucgGfuCfAfccuuUfcAfuaaugsusa |
| AD-240423.1 | 3848 | asusuaugAfaAfGfGfugaccgacuaL96 | 4144 | usAfsgucGfgUfCfaccuUfuCfauaausgsu |
| AD-240431.1 | 3849 | asgsgugaCfcGfAfCfucuauuuuaaL96 | 4145 | usUfsaaaAfuAfGfagucGfgUfcaccususu |
| AD-240446.1 | 3850 | asuscucaGfaAfUfUfuuaaguucuaL96 | 4146 | usAfsgaaCfuUfAfaaauUfcUfgagaususu |
| AD-240474.1 | 3851 | csusuucaUfaUfAfUfccuuggaccaL96 | 4147 | usGfsgacCfaAfGfgauAfuAfUfgaaagscsa |
| AD-240475.1 | 3852 | ususucauAfuAfUfCfcuuggucccaL96 | 4148 | usGfsggaCfcAfAfggauAfuAfugaaagsgsc |
| AD-240476.1 | 3853 | ususcauaUfaUfCfCfuuggucccaaL96 | 4149 | usUfsgggAfcCfAfaggaUfaUfaugaasasg |
| AD-240490.1 | 3854 | gsuscccaGfaGfAfUfguuuagacaaL96 | 4150 | usUfsgucUfaAfAfcaucUfcUfgggacscsa |
| AD-240494.1 | 3855 | csasgagaUfgUfUfUfagacaauuuuL96 | 4151 | asAfsaauUfgUfCfuaaaCfaUfcucugsgsg |
| AD-240495.1 | 3856 | asgsagauGfuUfTUfAfgacaauuuaL96 | 4152 | usAfsaaaUfuGfUfcuaaAfcAfucucusgsg |
| AD-240501.1 | 3857 | gsusuuagAfcAfAfUfuuuaaggcucaL96 | 4153 | usGfsagcCfuAfAfaauGfuCfuaaacsasu |
| AD-240502.1 | 3858 | ususuagaCfaAfUfUfuuaaggcucaaL96 | 4154 | usUfsgagCfcUfAfaaauUfgUfcuaaascsa |
| AD-240503.1 | 3859 | ususagacAfaUfUfUfuaaggcucaaL96 | 4155 | usUfsugaGfcCfUfaaaaUfuGfucuaasasc |
| AD-240504.1 | 3860 | usasgacaAfuUfUfUfaggcucaaaaL96 | 4156 | usUfsuugAfgCfCfuaaaAfuUfgucuasasa |
| AD-240505.1 | 3861 | asgsacaaUfuUfTUfAfggcucaaaaL96 | 4157 | usUfsuuuGfaAfGfCfcuaaAfaUfgucusasa |
| AD-240507.1 | 3862 | ascsauuUfuAfAfGfcucaaaaauuL96 | 4158 | asAfsuuuUfuGfUfAfgccuAfaAfauugscsu |
| AD-240512.1 | 3863 | ususuaggCfuCfAfAfaaauuaaagaL96 | 4159 | usCfsuuuAfaUfUfuuugAfgCfcuaaasasu |
| AD-240513.1 | 3864 | ususaggcUfcAfAfAfaauuaaagcuL96 | 4160 | asGfscuuUfaAfUfuuuuGfaGfccuaasasa |
| AD-240514.1 | 3865 | usasggcuCfaAfAfAfauuaaaagcuaL96 | 4161 | usAfsgcuUfuAfAfUfuuuuUfgAfgccuasasa |
| AD-240538.1 | 3866 | csasggaaAfaGfGfAfacuguacugaL96 | 4162 | usCfsaguAfcAfGfuuccUfuUfuccugsusg |
| AD-240540.1 | 3867 | gsgsaaaaGfgAfAfCfuguacuggcuL96 | 4163 | asGfsccaGfuAfCfaguuCfcUfuuuccsusg |
| AD-240542.1 | 3868 | asasaaggAfaCfUfGfuacuggcuauL96 | 4164 | asUfsagcCfaGfUfacagUfuCfcuuuuscsc |
| AD-240545.1 | 3869 | asgsgaacUfgUfAfCfuggcuauuaaL96 | 4165 | usUfsaauAfgCfCfaguaCfaGfuuccususu |
| AD-240546.1 | 3870 | gsgsgaacuGfuAfCfUfggcuauuacaL96 | 4166 | usGfsuaaUfaGfCfcaguAfcAfguuccsusu |
| AD-240779.1 | 3871 | usasauccGfaCfUfCfccacuacavaL96 | 4167 | usAfsuguAfgUfGfggagUfcGfauuasusu |
| AD-240782.1 | 3872 | cscsgacUfcCfCfAfcuacaucaaaL96 | 4168 | usUfsugaUfgUfAfguggGfaGfucggsusa |
| AD-240787.1 | 3873 | csuscccaCfuAfCfAfucaagacuaaL96 | 4169 | usUfsaguCfuUfGfauguAfgUfgggagsusc |
| AD-240788.1 | 3874 | uscsccacUfaCfAfUfcaagacuaauL96 | 4170 | asUfsuagUfcUfUfgaugUfaGfugggasgsu |
| AD-240789.1 | 3875 | cscscacuAfcAfUfCfaagacuaauaL96 | 4171 | usAfsuuaGfuCfUfugauGfuAfgugggsasg |
| AD-240790.1 | 3876 | cscscacuaCfaUfCfAfagacuaaucuL96 | 4172 | asGfsauuAfgUfCffuugaUfgUfaguggsgsa |
| AD-240792.1 | 3877 | ascsuacaUfcAfAfGfacuaaucuuaL96 | 4173 | usAfsagaUfuAfGfucuuGfaUfguagusgsg |
| AD-240793.1 | 3878 | csusacauCfaAfGfAfcuaaucuuguL96 | 4174 | asCfsaagAfuUfAfgucuUfgAfuguagsusg |
| AD-240794.1 | 3879 | usascaucAfaGfAfCfuaaucuuguuL96 | 4175 | asAfsaGfaUfUfagucUfuGfauguasgsu |
| AD-240795.1 | 3880 | ascsaucaAfgAfCfUfaaucuuguuuL96 | 4176 | asAfscaAfgAfUfuaguCfuUfgaugusasg |
| AD-240826.1 | 3881 | gsusauuaUfaGfAfAfufugcuuuugaaL96 | 4177 | usGfscaaAfaGfCfauucUfaUfaauacsasu |
| AD-240830.1 | 3882 | usasuagaAfuGfCfUfuuugcaunggaL96 | 4178 | usCfscauGfcAfAfaagcAfuUfcuauasasu |
| AD-240833.1 | 3883 | asgsaaugCfuUfUfUfgcauggacuaL96 | 4179 | usAfsgucCfaUfGfcaaaAfgCfauucususu |
| AD-240834.1 | 3884 | gsasaugcUfuUfUTUfGfcauggacuauL96 | 4180 | asUfsaguCfcAfUfgcaaAfaGfcauucsusa |
| AD-240837.1 | 3885 | usgscuuuUfgCfAfUfggacuacuuuL96 | 4181 | asGfsgauAfgUfCfcaugCffaCfaagcasusu |
| AD-240839.1 | 3886 | csusuuugCfaUfGfGfacuauccucuL96 | 4182 | asGfsaggAfuAfGfuccaUffgCfaaaagscsa |
| AD-240843.1 | 3887 | usgscaugGfaCfUfAfuccucuuguuL96 | 4183 | asAfscaaGfaGfGfauagUfcCfaugcasasa |
| AD-240844.1 | 3888 | gscsauggAfcUfAfUfccucuuguuuL96 | 4184 | asAfsacaAfgAfGfgauaGfuCfcaugcsasa |
| AD-240871.1 | 3889 | asasauaaCfcUfCfUfuguaguuauaL96 | 4185 | usAfsuaaCfuUfAfCaagaGfgUfuauuususu |
| AD-240875.1 | 3890 | asasccucUfuGfUfUfguuauaaauL96 | 4186 | asUfsuuuAfuAfAfcuacAfaGfgguusasu |

| Duplex Name | SEQ ID NO: | mRNA Target Sequence 5' to 3' |
|---|---|---|
| AD-238911.1 | 4187 | GACAGUACCUCCUCCCUAGGACU |
| AD-238912.1 | 4188 | ACAGUACCUCCUCCCUAGGACUA |
| AD-238913.1 | 4189 | CAGUACCUCCUCCCUAGGACUAC |
| AD-238929.1 | 4190 | GGACUACACAAGGACUGAACCAG |
| AD-238930.1 | 4191 | GACUACACAAGGACUGAACCAGA |
| AD-238932.1 | 4192 | CUACACAAGGACUGAACCAGAAG |
| AD-238960.1 | 4193 | GACAGAGCAAAGCCAUGAACAUC |
| AD-238979.1 | 4194 | CAUCAUCCUAGAAAUCCUUCUGC |
| AD-238991.1 | 4195 | AAUCCUUCUGCUUCUGAUCACCA |
| AD-239009.1 | 4196 | CACCAUCAUCUACUCCUACUUGG |
| AD-239015.1 | 4197 | CAUCUACUCCUACUUGGAGUCGU |
| AD-239016.1 | 4198 | AUCUACUCCUACUUGGAGUCGUU |
| AD-239017.1 | 4199 | UCUACUCCUACUUGGAGUCGUUG |
| AD-239018.1 | 4200 | CUACUCCUACUUGGAGUCGUUGG |
| AD-239019.1 | 4201 | UACUCCUACUUGGAGUCGUUGGU |
| AD-239020.1 | 4202 | ACUCCUACUUGGAGUCGUUGGUG |
| AD-239031.1 | 4203 | GAGUCGUUGGUGAAGUUUUUCAU |
| AD-239062.1 | 4204 | GGGAGAUUGUUCUCAUUACUGGA |
| AD-239066.1 | 4205 | GAUUGUUCUCAUUACUGGAGCUG |
| AD-239103.1 | 4206 | AGGCAGACUACUUAUGAAUUUGC |
| AD-239110.1 | 4207 | CUACUUAUGAAUUUGCAAAACGA |
| AD-239118.1 | 4208 | GAAUUUGCAAAACGACAGAGCAU |
| AD-239119.1 | 4209 | AAUUUGCAAAACGACAGAGCAUA |
| AD-239131.1 | 4210 | GACAGAGCAUAUUGGUUCUGUGG |
| AD-239132.1 | 4211 | ACAGAGCAUAUUGGUUCUGUGGG |
| AD-239133.1 | 4212 | CAGAGCAUAUUGGUUCUGUGGGA |
| AD-239146.1 | 4213 | UUCUGUGGGAUAUUAAUAAGCGC |
| AD-239155.1 | 4214 | AUAUUAAUAAGCGCGGUGUGGAG |

TABLE 3-continued

HSD17B13 Modified Sequences

| | | |
|---|---|---|
| AD-239156.1 | 4215 | UAUUAAUAAGCGCGGUGUGGAGG |
| AD-239177.1 | 4216 | GGAAACUGCAGCUGAGUGCCGAA |
| AD-239178.1 | 4217 | GAAACUGCAGCUGAGUGCCGAAA |
| AD-239179.1 | 4218 | AAACUGCAGCUGAGUGCCGAAAA |
| AD-239180.1 | 4219 | AACUGCAGCUGAGUGCCGAAAAC |
| AD-239181.1 | 4220 | ACUGCAGCUGAGUGCCGAAAACU |
| AD-239182.1 | 4221 | CUGCAGCUGAGUGCCGAAAACUA |
| AD-239183.1 | 4222 | UGCAGCUGAGUGCCGAAAACUAG |
| AD-239185.1 | 4223 | CAGCUGAGUGCCGAAAACUAGGC |
| AD-239186.1 | 4224 | AGCUGAGUGCCGAAAACUAGGCG |
| AD-239187.1 | 4225 | GCUGAGUGCCGAAAACUAGGCGU |
| AD-239188.1 | 4226 | CUGAGUGCCGAAAACUAGGCGUC |
| AD-239189.1 | 4227 | UGAGUGCCGAAAACUAGGCGUCA |
| AD-239190.1 | 4228 | GAGUGCCGAAAACUAGGCGUCAC |
| AD-239191.1 | 4229 | AGUGCCGAAAACUAGGCGUCACU |
| AD-239192.1 | 4230 | GUGCCGAAAACUAGGCGUCACUG |
| AD-239193.1 | 4231 | UGCCGAAAACUAGGCGUCACUGC |
| AD-239194.1 | 4232 | GCCGAAAACUAGGCGUCACUGCG |
| AD-239196.1 | 4233 | CGAAAACUAGGCGUCACUGCGCA |
| AD-239198.1 | 4234 | AAAACUAGGCGUCACUGCGCAUG |
| AD-239199.1 | 4235 | AAACUAGGCGUCACUGCGCAUGC |
| AD-239203.1 | 4236 | UAGGCGUCACUGCGCAUGCGUAU |
| AD-239214.1 | 4237 | GCGCAUGCGUAUGUGGUAGACUG |
| AD-239215.1 | 4238 | CGCAUGCGUAUGUGGUAGACUGC |
| AD-239239.1 | 4239 | GCAACAGAGAAGAGAUCUAUCGC |
| AD-239240.1 | 4240 | CAACAGAGAAGAGAUCUAUCGCU |
| AD-239241.1 | 4241 | AACAGAGAAGAGAUCUAUCGCUC |
| AD-239242.1 | 4242 | ACAGAGAAGAGAUCUAUCGCUCU |
| AD-239243.1 | 4243 | CAGAGAAGAGAUCUAUCGCUCUC |
| AD-239245.1 | 4244 | GAGAAGAGAUCUAUCGCUCUCUA |
| AD-239246.1 | 4245 | AGAAGAGAUCUAUCGCUCUCUAA |
| AD-239247.1 | 4246 | GAAGAGAUCUAUCGCUCUCUAAA |
| AD-239250.1 | 4247 | GAGAUCUAUCGCUCUCUAAAUCA |
| AD-239251.1 | 4248 | AGAUCUAUCGCUCUCUAAAUCAG |
| AD-239253.1 | 4249 | AUCUAUCGCUCUCUAAAUCAGGU |
| AD-239254.1 | 4250 | UCUAUCGCUCUCUAAAUCAGGUG |
| AD-239255.1 | 4251 | CUAUCGCUCUCUAAAUCAGGUGA |
| AD-239290.1 | 4252 | GUGAUGUAACAAUCGUGGUGAAU |
| AD-239291.1 | 4253 | UGAUGUAACAAUCGUGGUGAAUA |
| AD-239292.1 | 4254 | GAUGUAACAAUCGUGGUGAAUAA |
| AD-239293.1 | 4255 | AUGUAACAAUCGUGGUGAAUAAU |
| AD-239304.1 | 4256 | GUGGUGAAUAAUGCUGGGACAGU |
| AD-239312.1 | 4257 | UAAUGCUGGGACAGUAUAUCCAG |
| AD-239313.1 | 4258 | AAUGCUGGGACAGUAUAUCCAGC |
| AD-239314.1 | 4259 | AUGCUGGGACAGUAUAUCCAGCC |
| AD-239316.1 | 4260 | GCUGGGACAGUAUAUCCAGCCGA |
| AD-239317.1 | 4261 | CUGGGACAGUAUAUCCAGCCGAU |
| AD-239318.1 | 4262 | UGGGACAGUAUAUCCAGCCGAUC |
| AD-239321.1 | 4263 | GACAGUAUAUCCAGCCGAUCUUC |
| AD-239332.1 | 4264 | CAGCCGAUCUUCUCAGCACCAAG |
| AD-239337.1 | 4265 | GAUCUUCUCAGCACCAAGGAUGA |
| AD-239348.1 | 4266 | CACCAAGGAUGAAGAGAUUACCA |
| AD-239362.1 | 4267 | AGAUUACCAAGACAUUUGAGGUC |
| AD-239366.1 | 4268 | UACCAAGACAUUUGAGGUCAACA |
| AD-239368.1 | 4269 | CCAAGACAUUUGAGGUCAACAUC |
| AD-239372.1 | 4270 | GACAUUUGAGGUCAACAUCCUAG |
| AD-239373.1 | 4271 | ACAUUUGAGGUCAACAUCCUAGG |
| AD-239379.1 | 4272 | GAGGUCAACAUCCUAGGACAUUU |
| AD-239380.1 | 4273 | AGGUCAACAUCCUAGGACAUUUU |
| AD-239387.1 | 4274 | CAUCCUAGGACAUUUUGGAUCA |
| AD-239397.1 | 4275 | CAUUUUUGGAUCACAAAAGCACU |
| AD-239411.1 | 4276 | AAAAGCACUUCUUCCAUCGAUGA |
| AD-239412.1 | 4277 | AAAGCACUUCUUCCAUCGAUGAU |
| AD-239431.1 | 4278 | UGAUGGAGAGAAAUCAUGGCCAC |
| AD-239433.1 | 4279 | AUGGAGAGAAAUCAUGGCCACAU |
| AD-239436.1 | 4280 | GAGAGAAAUCAUGGCCACAUCGU |
| AD-239437.1 | 4281 | AGAGAAAUCAUGGCCACAUCGUC |
| AD-239438.1 | 4282 | GAGAAAUCAUGGCCACAUCGUCA |
| AD-239439.1 | 4283 | AGAAAUCAUGGCCACAUCGUCAC |
| AD-239450.1 | 4284 | CCACAUCGUCACAGUGGCUUCAG |
| AD-239451.1 | 4285 | CACAUCGUCACAGUGGCUUCAGU |
| AD-239452.1 | 4286 | ACAUCGUCACAGUGGCUUCAGUG |
| AD-239453.1 | 4287 | CAUCGUCACAGUGGCUUCAGUGU |
| AD-239475.1 | 4288 | UGCGGCCACGAAGGGAUUCCUUA |
| AD-239476.1 | 4289 | GCGGCCACGAAGGGAUUCCUUAC |
| AD-239478.1 | 4290 | GGCCACGAAGGGAUUCCUUACCU |
| AD-239479.1 | 4291 | GCCACGAAGGGAUUCCUUACCUC |
| AD-239480.1 | 4292 | CCACGAAGGGAUUCCUUACCUCA |

TABLE 3-continued

HSD17B13 Modified Sequences

| | | |
|---|---|---|
| AD-239482.1 | 4293 | ACGAAGGGAUUCCUUACCUCAUC |
| AD-239483.1 | 4294 | CGAAGGGAUUCCUUACCUCAUCC |
| AD-239499.1 | 4295 | CUCAUCCCAUAUUGUUCCAGCAA |
| AD-239510.1 | 4296 | UUGUUCCAGCAAAUUUGCCGCUG |
| AD-239520.1 | 4297 | AAAUUUGCCGCUGUUGGCUUUCA |
| AD-239521.1 | 4298 | AAUUUGCCGCUGUUGGCUUUCAC |
| AD-239522.1 | 4299 | AUUUGCCGCUGUUGGCUUUCACA |
| AD-239534.1 | 4300 | UGGCUUUCACAGAGGUCUGACAU |
| AD-239539.1 | 4301 | UUCACAGAGGUCUGACAUCAGAA |
| AD-239544.1 | 4302 | AGAGGUCUGACAUCAGAACUUCA |
| AD-239566.1 | 4303 | AGGCCUUGGGAAAAACUGGUAUC |
| AD-239578.1 | 4304 | AAACUGGUAUCAAAACCUCAUGU |
| AD-239579.1 | 4305 | AACUGGUAUCAAAACCUCAUGUC |
| AD-239611.1 | 4306 | UUUUUGUGAAUACUGGGUUCACC |
| AD-239612.1 | 4307 | UUUUGUGAAUACUGGGUUCACCA |
| AD-239613.1 | 4308 | UUUGUGAAUACUGGGUUCACCAA |
| AD-239617.1 | 4309 | UGAAUACUGGGUUCACCAAAAAU |
| AD-239618.1 | 4310 | GAAUACUGGGUUCACCAAAAAUC |
| AD-239637.1 | 4311 | AAUCCAAGCACAAGAUUAUGGCC |
| AD-239641.1 | 4312 | CAAGCACAAGAUUAUGGCCUGUA |
| AD-239642.1 | 4313 | AAGCACAAGAUUAUGGCCUGUAU |
| AD-239643.1 | 4314 | AGCACAAGAUUAUGGCCUGUAUU |
| AD-239645.1 | 4315 | CACAAGAUUAUGGCCUGUAUUGG |
| AD-239647.1 | 4316 | CAAGAUUAUGGCCUGUAUUGGAG |
| AD-239649.1 | 4317 | AGAUUAUGGCCUGUAUUGGAGAC |
| AD-239650.1 | 4318 | GAUUAUGGCCUGUAUUGGAGACA |
| AD-239653.1 | 4319 | UAUGGCCUGUAUUGGAGACAGAU |
| AD-239654.1 | 4320 | AUGGCCUGUAUUGGAGACAGAUG |
| AD-239662.1 | 4321 | UAUUGGAGACAGAUGAAGUCGUA |
| AD-239668.1 | 4322 | AGACAGAUGAAGUCGUAAGAAGU |
| AD-239669.1 | 4323 | GACAGAUGAAGUCGUAAGAAGUC |
| AD-239670.1 | 4324 | ACAGAUGAAGUCGUAAGAAGUCU |
| AD-239671.1 | 4325 | CAGAUGAAGUCGUAAGAAGUCUG |
| AD-239674.1 | 4326 | AUGAAGUCGUAAGAAGUCUGAUA |
| AD-239676.1 | 4327 | GAAGUCGUAAGAAGUCUGAUAGA |
| AD-239681.1 | 4328 | CGUAAGAAGUCUGAUAGAUGGAA |
| AD-239682.1 | 4329 | GUAAGAAGUCUGAUAGAUGGAAU |
| AD-239684.1 | 4330 | AAGAAGUCUGAUAGAUGGAAUAC |
| AD-239685.1 | 4331 | AGAAGUCUGAUAGAUGGAAUACU |
| AD-239697.1 | 4332 | GAUGGAAUACUUACCAAUAAGAA |
| AD-239713.1 | 4333 | AAAAUGAUUUUGUUCCAUCGUA |
| AD-239714.1 | 4334 | AAAUGAUUUUGUUCCAUCGUAU |
| AD-239717.1 | 4335 | UGAUUUUGUUCCAUCGUAUAUC |
| AD-239721.1 | 4336 | UUUUGUUCCAUCGUAUAUCAAUA |
| AD-239723.1 | 4337 | UUGUUCCAUCGUAUAUCAAUAUC |
| AD-239724.1 | 4338 | UGUUCCAUCGUAUAUCAAUAUCU |
| AD-239725.1 | 4339 | GUUCCAUCGUAUAUCAAUAUCUU |
| AD-239726.1 | 4340 | UUCCAUCGUAUAUCAAUAUCUUU |
| AD-239755.1 | 4341 | CUACAGAAGUUUCUUCCUGAACG |
| AD-239757.1 | 4342 | ACAGAAGUUUCUUCCUGAACGCG |
| AD-239759.1 | 4343 | AGAAGUUUCUUCCUGAACGCGCC |
| AD-239761.1 | 4344 | AAGUUUCUUCCUGAACGCGCCUC |
| AD-239764.1 | 4345 | UUUCUUCCUGAACGCGCCUCAGC |
| AD-239778.1 | 4346 | CGCCUCAGCGAUUUUAAAUCGUA |
| AD-239779.1 | 4347 | GCCUCAGCGAUUUUAAAUCGUAU |
| AD-239780.1 | 4348 | CCUCAGCGAUUUUAAAUCGUAUG |
| AD-239781.1 | 4349 | CUCAGCGAUUUUAAAUCGUAUGC |
| AD-239782.1 | 4350 | UCAGCGAUUUUAAAUCGUAUGCA |
| AD-239783.1 | 4351 | CAGCGAUUUUAAAUCGUAUGCAG |
| AD-239784.1 | 4352 | AGCGAUUUUAAAUCGUAUGCAGA |
| AD-239785.1 | 4353 | GCGAUUUUAAAUCGUAUGCAGAA |
| AD-239786.1 | 4354 | CGAUUUUAAAUCGUAUGCAGAAU |
| AD-239787.1 | 4355 | GAUUUUAAAUCGUAUGCAGAAUA |
| AD-239791.1 | 4356 | UUAAAUCGUAUGCAGAAUAUUCA |
| AD-239793.1 | 4357 | AAAUCGUAUGCAGAAUAUUCAAU |
| AD-239806.1 | 4358 | AAUAUUCAAUUUGAAGCAGUGGU |
| AD-239839.1 | 4359 | AUGAAUAAAUAAGCUCCAGCCAG |
| AD-239840.1 | 4360 | UGAAUAAAUAAGCUCCAGCCAGA |
| AD-239854.1 | 4361 | CCAGCCAGAGAUGUAUGCAUGAU |
| AD-239855.1 | 4362 | CAGCCAGAGAUGUAUGCAUGAUA |
| AD-239876.1 | 4363 | UGAUAUGAAUAGUUUCGAAUCAA |
| AD-239877.1 | 4364 | GAUAUGAAUAGUUUCGAAUCAAU |
| AD-239881.1 | 4365 | UGAAUAGUUUCGAAUCAAUGCUG |
| AD-239905.1 | 4366 | UUUUCAGUCCUGAUAAUAUUAAA |
| AD-239914.1 | 4367 | UUUAAAAACAUUGGUUUGGCACUA |
| AD-239915.1 | 4368 | UAAAAACAUUGGUUUGGCACUAG |
| AD-239941.1 | 4369 | CAGUCAAACGAACAAGAUUAAUU |
| AD-239944.1 | 4370 | UCAAACGAACAAGAUUAAUUACC |

TABLE 3-continued

HSD17B13 Modified Sequences

| | | |
|---|---|---|
| AD-239945.1 | 4371 | CAAACGAACAAGAUUAAUUACCU |
| AD-239946.1 | 4372 | AAACGAACAAGAUUAAUUACCUG |
| AD-239947.1 | 4373 | AACGAACAAGAUUAAUUACCUGU |
| AD-239977.1 | 4374 | UUUCUCAAGAAUAUUUACGUAGU |
| AD-239979.1 | 4375 | UCUCAAGAAUAUUUACGUAGUUU |
| AD-239980.1 | 4376 | CUCAAGAAUAUUUACGUAGUUUU |
| AD-239998.1 | 4377 | UUUUUCAUAGGUCUGUUUUUCCU |
| AD-240019.1 | 4378 | CUUUCAUGCCUCUUAAAAACUUC |
| AD-240031.1 | 4379 | UUAAAAACUUCUGUGCUUACAUA |
| AD-240032.1 | 4380 | UAAAAACUUCUGUGCUUACAUAA |
| AD-240033.1 | 4381 | AAAAACUUCUGUGCUUACAUAAA |
| AD-240064.1 | 4382 | UAUUUUUCCAUUUAAAGGUGGAC |
| AD-240090.1 | 4383 | AGCUACCUCCCUAAAAGUAAAUA |
| AD-240091.1 | 4384 | GCUACCUCCCUAAAAGUAAAUAC |
| AD-240108.1 | 4385 | AAUACAAAGAGAACUUAUUUACA |
| AD-240117.1 | 4386 | AGAACUUAUUUACACAGGGAAGG |
| AD-240124.1 | 4387 | AUUUACACAGGGAAGGUUUAAGA |
| AD-240125.1 | 4388 | UUUACACAGGGAAGGUUUAAGAC |
| AD-240126.1 | 4389 | UUACACAGGGAAGGUUUAAGACU |
| AD-240135.1 | 4390 | GAAGGUUUAAGACUGUUCAAGUA |
| AD-240138.1 | 4391 | GGUUUAAGACUGUUCAAGUAGCA |
| AD-240140.1 | 4392 | UUUAAGACUGUUCAAGUAGCAUU |
| AD-240142.1 | 4393 | UAAGACUGUUCAAGUAGCAUUCC |
| AD-240145.1 | 4394 | GACUGUUCAAGUAGCAUUCCAAU |
| AD-240147.1 | 4395 | CUGUUCAAGUAGCAUUCCAAUCU |
| AD-240148.1 | 4396 | UGUUCAAGUAGCAUUCCAAUCUG |
| AD-240154.1 | 4397 | AGUAGCAUUCCAAUCUGUAGCCA |
| AD-240155.1 | 4398 | GUAGCAUUCCAAUCUGUAGCCAU |
| AD-240156.1 | 4399 | UAGCAUUCCAAUCUGUAGCCAUG |
| AD-240171.1 | 4400 | UAGCCAUGCCACAGAAUAUCAAC |
| AD-240172.1 | 4401 | AGCCAUGCCACAGAAUAUCAACA |
| AD-240192.1 | 4402 | ACAAGAACACAGAAUGAGUGCAC |
| AD-240227.1 | 4403 | AAGUUUCAGCAGGCAGCUUUAUC |
| AD-240228.1 | 4404 | AGUUUCAGCAGGCAGCUUUAUCU |
| AD-240237.1 | 4405 | AGGCAGCUUUAUCUCAACCUGGA |
| AD-240245.1 | 4406 | UUAUCUCAACCUGGACAUAUUUU |
| AD-240276.1 | 4407 | GCAUUUGAAAGAUUUCCCUAGCC |
| AD-240278.1 | 4408 | AUUUGAAAGAUUUCCCUAGCCUC |
| AD-240279.1 | 4409 | UUUGAAAGAUUUCCCUAGCCUCU |
| AD-240280.1 | 4410 | UUGAAAGAUUUCCCUAGCCUCUU |
| AD-240308.1 | 4411 | UUCAUUAGCCCAAAACGGUGCAA |
| AD-240309.1 | 4412 | UCAUUAGCCCAAAACGGUGCAAC |
| AD-240310.1 | 4413 | CAUUAGCCCAAAACGGUGCAACU |
| AD-240311.1 | 4414 | AUUAGCCCAAAACGGUGCAACUC |
| AD-240312.1 | 4415 | UUAGCCCAAAACGGUGCAACUCU |
| AD-240313.1 | 4416 | UAGCCCAAAACGGUGCAACUCUA |
| AD-240315.1 | 4417 | GCCCAAAACGGUGCAACUCUAUU |
| AD-240317.1 | 4418 | CCAAAACGGUGCAACUCUAUUCU |
| AD-240318.1 | 4419 | CAAAACGGUGCAACUCUAUUCUG |
| AD-240319.1 | 4420 | AAAACGGUGCAACUCUAUUCUGG |
| AD-240322.1 | 4421 | ACGGUGCAACUCUAUUCUGGACU |
| AD-240324.1 | 4422 | GGUGCAACUCUAUUCUGGACUUU |
| AD-240326.1 | 4423 | UGCAACUCUAUUCUGGACUUUAU |
| AD-240327.1 | 4424 | GCAACUCUAUUCUGGACUUUAUU |
| AD-240333.1 | 4425 | CUAUUCUGGACUUUAUUACUUGA |
| AD-240364.1 | 4426 | UCUGUAUAACUCUGAAGUCCACC |
| AD-240365.1 | 4427 | CUGUAUAACUCUGAAGUCCACCA |
| AD-240375.1 | 4428 | CUGAAGUCCACCAAAAGUGGACC |
| AD-240378.1 | 4429 | AAGUCCACCAAAAGUGGACCCUC |
| AD-240381.1 | 4430 | UCCACCAAAAGUGGACCCUCUAU |
| AD-240382.1 | 4431 | CCACCAAAAGUGGACCCUCUAUA |
| AD-240383.1 | 4432 | CACCAAAAGUGGACCCUCUAUAU |
| AD-240385.1 | 4433 | CCAAAAGUGGACCCUCUAUAUUU |
| AD-240386.1 | 4434 | CAAAAGUGGACCCUCUAUAUUUC |
| AD-240387.1 | 4435 | AAAAGUGGACCCUCUAUAUUUCC |
| AD-240419.1 | 4436 | AGAUACAUUAUGAAAGGUGACCG |
| AD-240420.1 | 4437 | GAUACAUUAUGAAAGGUGACCGA |
| AD-240421.1 | 4438 | AUACAUUAUGAAAGGUGACCGAC |
| AD-240422.1 | 4439 | UACAUUAUGAAAGGUGACCGACU |
| AD-240423.1 | 4440 | ACAUUAUGAAAGGUGACCGACUC |
| AD-240431.1 | 4441 | AAAGGUGACCGACUCUAUUUUAA |
| AD-240446.1 | 4442 | AAAUCUCAGAAUUUUAAGUUCUA |
| AD-240474.1 | 4443 | UGCUUUCAUAUAUCCUUGGUCCC |
| AD-240475.1 | 4444 | GCUUUCAUAUAUCCUUGGUCCCA |
| AD-240476.1 | 4445 | CUUUCAUAUAUCCUUGGUCCCAG |
| AD-240490.1 | 4446 | UGGUCCCAGAGAUGUUUAGACAA |
| AD-240494.1 | 4447 | CCCAGAGAUGUUUAGACAAUUUU |
| AD-240495.1 | 4448 | CCAGAGAUGUUUAGACAAUUUUA |

TABLE 3-continued

HSD17B13 Modified Sequences

| | | |
|---|---|---|
| AD-240501.1 | 4449 | AUGUUUAGACAAUUUUAGGCUCA |
| AD-240502.1 | 4450 | UGUUUAGACAAUUUUAGGCUCAA |
| AD-240503.1 | 4451 | GUUUAGACAAUUUUAGGCUCAAA |
| AD-240504.1 | 4452 | UUUAGACAAUUUUAGGCUCAAAA |
| AD-240505.1 | 4453 | UUAGACAAUUUUAGGCUCAAAAA |
| AD-240507.1 | 4454 | AGACAAUUUUAGGCUCAAAAAUU |
| AD-240512.1 | 4455 | AUUUUAGGCUCAAAAAUUAAAGC |
| AD-240513.1 | 4456 | UUUUAGGCUCAAAAAUUAAAGCU |
| AD-240514.1 | 4457 | UUUAGGCUCAAAAAUUAAAGCUA |
| AD-240538.1 | 4458 | CACAGGAAAAGGAACUGUACUGG |
| AD-240540.1 | 4459 | CAGGAAAAGGAACUGUACUGGCU |
| AD-240542.1 | 4460 | GGAAAAGGAACUGUACUGGCUAU |
| AD-240545.1 | 4461 | AAAGGAACUGUACUGGCUAUUAC |
| AD-240546.1 | 4462 | AAGGAACUGUACUGGCUAUUACA |
| AD-240779.1 | 4463 | AAUAAUCCGACUCCCACUACAUC |
| AD-240782.1 | 4464 | AAUCCGACUCCCACUACAUCAAG |
| AD-240787.1 | 4465 | GACUCCCACUACAUCAAGACUAA |
| AD-240788.1 | 4466 | ACUCCCACUACAUCAAGACUAAU |
| AD-240789.1 | 4467 | CUCCCACUACAUCAAGACUAAUC |
| AD-240790.1 | 4468 | UCCCACUACAUCAAGACUAAUCU |
| AD-240792.1 | 4469 | CCACUACAUCAAGACUAAUCUUG |
| AD-240793.1 | 4470 | CACUACAUCAAGACUAAUCUUGU |
| AD-240794.1 | 4471 | ACUACAUCAAGACUAAUCUUGUU |
| AD-240795.1 | 4472 | CUACAUCAAGACUAAUCUUGUUU |
| AD-240826.1 | 4473 | AUGUAUUAUAGAAUGCUUUUGCA |
| AD-240830.1 | 4474 | AUUAUAGAAUGCUUUUGCAUGGA |
| AD-240833.1 | 4475 | AUAGAAUGCUUUUGCAUGGACUA |
| AD-240834.1 | 4476 | UAGAAUGCUUUUGCAUGGACUAU |
| AD-240837.1 | 4477 | AAUGCUUUUGCAUGGACUAUCCU |
| AD-240839.1 | 4478 | UGCUUUUGCAUGGACUAUCCUCU |
| AD-240843.1 | 4479 | UUUGCAUGGACUAUCCUCUUGUU |
| AD-240844.1 | 4480 | UUGCAUGGACUAUCCUCUUGUUU |
| AD-240871.1 | 4481 | AAAAAUAACCUCUUGUAGUUAUA |
| AD-240875.1 | 4482 | AUAACCUCUUGUAGUUAUAAAAU |

TABLE 4

HSD17B13 in vitro 50 nM screen in Cos-7
(Dual-Luciferase psiCHECK2 vector)

| Duplex Name | % of Human Message Remaining 50 nM | STDEV 50 nM |
|---|---|---|
| AD-238911.1 | 56.0 | 9.0 |
| AD-238912.1 | 103.7 | 14.5 |
| AD-238913.1 | 51.6 | 9.4 |
| AD-238929.1 | 51.8 | 10.1 |
| AD-238930.1 | 63.6 | 6.7 |
| AD-238932.1 | 53.7 | 10.3 |
| AD-238960.1 | 35.1 | 3.6 |
| AD-238979.1 | 25.6 | 4.7 |
| AD-238991.1 | 31.8 | 2.0 |
| AD-239009.1 | 81.1 | 15.9 |
| AD-239015.1 | 94.7 | 11.3 |
| AD-239016.1 | 63.8 | 4.5 |
| AD-239017.1 | 45.4 | 9.9 |
| AD-239018.1 | 68.7 | 10.7 |
| AD-239019.1 | 36.9 | 7.4 |
| AD-239020.1 | 52.7 | 5.1 |
| AD-239031.1 | 19.4 | 2.5 |
| AD-239062.1 | 33.5 | 6.4 |
| AD-239066.1 | 45.5 | 3.8 |
| AD-239103.1 | 12.8 | 1.3 |
| AD-239110.1 | 14.0 | 2.1 |
| AD-239118.1 | 57.0 | 8.6 |
| AD-239119.1 | 38.6 | 1.6 |
| AD-239131.1 | 65.9 | 9.1 |
| AD-239132.1 | 39.4 | 13.4 |
| AD-239133.1 | 31.7 | 3.2 |
| AD-239146.1 | 13.5 | 1.6 |
| AD-239155.1 | 27.5 | 1.9 |
| AD-239156.1 | 81.1 | 12.5 |
| AD-239177.1 | 27.7 | 5.2 |
| AD-239178.1 | 60.6 | 7.0 |
| AD-239179.1 | 42.9 | 8.4 |
| AD-239180.1 | 83.8 | 16.0 |
| AD-239181.1 | 43.2 | 8.0 |
| AD-239182.1 | 34.0 | 5.5 |
| AD-239183.1 | 24.3 | 3.1 |
| AD-239185.1 | 82.9 | 12.6 |
| AD-239186.1 | 89.0 | 9.8 |
| AD-239187.1 | 85.1 | 18.1 |
| AD-239188.1 | 64.5 | 3.0 |
| AD-239189.1 | 70.7 | 8.9 |
| AD-239190.1 | 91.9 | 7.9 |
| AD-239191.1 | 58.9 | 10.3 |
| AD-239192.1 | 60.7 | 17.3 |
| AD-239193.1 | 61.9 | 8.1 |
| AD-239194.1 | 74.4 | 6.2 |
| AD-239196.1 | 94.7 | 17.1 |
| AD-239198.1 | 100.9 | 22.5 |
| AD-239199.1 | 47.3 | 12.8 |
| AD-239203.1 | 40.4 | 2.3 |
| AD-239214.1 | 33.3 | 6.2 |
| AD-239215.1 | 38.9 | 8.4 |
| AD-239239.1 | 53.4 | 7.2 |
| AD-239240.1 | 27.8 | 1.8 |
| AD-239241.1 | 51.4 | 11.1 |
| AD-239242.1 | 17.8 | 2.1 |
| AD-239243.1 | 54.1 | 12.2 |
| AD-239245.1 | 51.6 | 9.6 |
| AD-239246.1 | 21.8 | 4.1 |
| AD-239247.1 | 30.9 | 5.0 |
| AD-239250.1 | 54.2 | 8.4 |
| AD-239251.1 | 15.9 | 6.0 |

TABLE 4-continued

HSD17B13 in vitro 50 nM screen in Cos-7 (Dual-Luciferase psiCHECK2 vector)

| Duplex Name | % of Human Message Remaining 50 nM | STDEV 50 nM |
|---|---|---|
| AD-239253.1 | 22.4 | 5.0 |
| AD-239254.1 | 47.2 | 15.2 |
| AD-239255.1 | 49.1 | 5.7 |
| AD-239290.1 | 31.4 | 8.3 |
| AD-239291.1 | 27.9 | 8.6 |
| AD-239292.1 | 30.2 | 4.2 |
| AD-239293.1 | 51.8 | 16.1 |
| AD-239304.1 | 61.4 | 11.8 |
| AD-239312.1 | 99.1 | 12.9 |
| AD-239313.1 | 95.8 | 5.0 |
| AD-239314.1 | 84.2 | 4.7 |
| AD-239316.1 | 52.2 | 2.2 |
| AD-239317.1 | 27.7 | 4.6 |
| AD-239318.1 | 33.6 | 8.4 |
| AD-239321.1 | 37.5 | 3.1 |
| AD-239332.1 | 28.5 | 5.9 |
| AD-239337.1 | 52.0 | 17.0 |
| AD-239348.1 | 26.0 | 4.3 |
| AD-239362.1 | 49.7 | 7.9 |
| AD-239366.1 | 68.4 | 10.0 |
| AD-239368.1 | 26.9 | 3.5 |
| AD-239372.1 | 48.0 | 6.3 |
| AD-239373.1 | 50.8 | 12.0 |
| AD-239379.1 | 21.5 | 6.9 |
| AD-239380.1 | 18.1 | 3.2 |
| AD-239387.1 | 16.6 | 1.6 |
| AD-239397.1 | 15.3 | 2.3 |
| AD-239411.1 | 46.6 | 12.2 |
| AD-239412.1 | 76.0 | 19.4 |
| AD-239431.1 | 60.2 | 8.3 |
| AD-239433.1 | 58.5 | 11.7 |
| AD-239436.1 | 77.6 | 5.7 |
| AD-239437.1 | 46.9 | 6.2 |
| AD-239438.1 | 89.3 | 27.8 |
| AD-239439.1 | 61.7 | 13.6 |
| AD-239450.1 | 67.4 | 4.5 |
| AD-239451.1 | 38.9 | 7.3 |
| AD-239452.1 | 84.0 | 17.0 |
| AD-239453.1 | 69.1 | 4.1 |
| AD-239475.1 | 77.3 | 13.1 |
| AD-239476.1 | 67.4 | 15.1 |
| AD-239478.1 | 79.3 | 6.2 |
| AD-239479.1 | 58.0 | 4.6 |
| AD-239480.1 | 26.6 | 2.8 |
| AD-239482.1 | 24.3 | 5.8 |
| AD-239483.1 | 39.7 | 8.7 |
| AD-239499.1 | 53.4 | 11.4 |
| AD-239510.1 | 64.1 | 7.5 |
| AD-239520.1 | 21.1 | 3.2 |
| AD-239521.1 | 26.4 | 7.7 |
| AD-239522.1 | 34.2 | 4.4 |
| AD-239534.1 | 64.5 | 14.1 |
| AD-239539.1 | 68.8 | 10.5 |
| AD-239544.1 | 48.5 | 10.2 |
| AD-239566.1 | 43.3 | 5.3 |
| AD-239578.1 | 19.3 | 1.8 |
| AD-239579.1 | 67.0 | 7.5 |
| AD-239611.1 | 43.1 | 10.0 |
| AD-239612.1 | 54.7 | 2.8 |
| AD-239613.1 | 69.7 | 12.4 |
| AD-239617.1 | 108.1 | 8.3 |
| AD-239618.1 | 32.5 | 8.9 |
| AD-239637.1 | 29.8 | 7.2 |
| AD-239641.1 | 52.6 | 8.7 |
| AD-239642.1 | 11.4 | 2.0 |
| AD-239643.1 | 17.2 | 5.2 |
| AD-239645.1 | 30.5 | 8.5 |
| AD-239647.1 | 33.6 | 4.5 |
| AD-239649.1 | 38.4 | 2.2 |
| AD-239650.1 | 79.5 | 16.5 |
| AD-239653.1 | 42.8 | 7.3 |
| AD-239654.1 | 74.4 | 7.0 |
| AD-239662.1 | 26.8 | 7.9 |
| AD-239668.1 | 27.3 | 3.8 |
| AD-239669.1 | 27.7 | 6.0 |
| AD-239670.1 | 23.1 | 3.0 |
| AD-239671.1 | 21.1 | 7.9 |
| AD-239674.1 | 16.4 | 4.9 |
| AD-239676.1 | 31.3 | 6.6 |
| AD-239681.1 | 19.4 | 5.5 |
| AD-239682.1 | 39.9 | 2.9 |
| AD-239684.1 | 56.3 | 9.9 |
| AD-239685.1 | 29.4 | 6.0 |
| AD-239697.1 | 26.9 | 2.2 |
| AD-239713.1 | 28.4 | 4.6 |
| AD-239714.1 | 10.4 | 1.1 |
| AD-239717.1 | 18.3 | 1.5 |
| AD-239721.1 | 14.4 | 3.7 |
| AD-239723.1 | 54.7 | 4.1 |
| AD-239724.1 | 18.5 | 4.7 |
| AD-239725.1 | 27.2 | 7.2 |
| AD-239726.1 | 29.8 | 4.7 |
| AD-239755.1 | 14.3 | 11.2 |
| AD-239757.1 | 36.0 | 4.1 |
| AD-239759.1 | 23.8 | 5.5 |
| AD-239761.1 | 73.7 | 8.8 |
| AD-239764.1 | 91.7 | 7.8 |
| AD-239778.1 | 25.3 | 8.7 |
| AD-239779.1 | 20.0 | 4.1 |
| AD-239780.1 | 28.9 | 7.3 |
| AD-239781.1 | 14.1 | 3.5 |
| AD-239782.1 | 22.3 | 3.8 |
| AD-239783.1 | 10.1 | 1.7 |
| AD-239784.1 | 16.6 | 5.5 |
| AD-239785.1 | 15.0 | 3.4 |
| AD-239786.1 | 11.9 | 0.8 |
| AD-239787.1 | 8.6 | 2.1 |
| AD-239791.1 | 15.8 | 2.3 |
| AD-239793.1 | 9.9 | 0.5 |
| AD-239806.1 | 33.1 | 11.4 |
| AD-239839.1 | 40.2 | 8.9 |
| AD-239840.1 | 47.9 | 5.6 |
| AD-239854.1 | 27.8 | 9.0 |
| AD-239855.1 | 16.6 | 1.4 |
| AD-239876.1 | 25.6 | 10.2 |
| AD-239877.1 | 8.9 | 0.9 |
| AD-239881.1 | 11.1 | 2.7 |
| AD-239905.1 | 18.2 | 1.8 |
| AD-239914.1 | 28.2 | 4.6 |
| AD-239915.1 | 37.4 | 8.6 |
| AD-239941.1 | 18.0 | 6.7 |
| AD-239944.1 | 35.4 | 5.9 |
| AD-239945.1 | 18.5 | 2.6 |
| AD-239946.1 | 19.5 | 6.6 |
| AD-239947.1 | 17.5 | 4.3 |
| AD-239977.1 | 13.7 | 2.7 |
| AD-239979.1 | 12.5 | 3.8 |
| AD-239980.1 | 12.9 | 2.6 |
| AD-239998.1 | 32.1 | 2.1 |
| AD-240019.1 | 25.1 | 3.2 |
| AD-240031.1 | 12.4 | 2.4 |
| AD-240032.1 | 30.6 | 3.2 |
| AD-240033.1 | 30.8 | 1.5 |
| AD-240064.1 | 19.6 | 4.1 |
| AD-240090.1 | 96.3 | 8.5 |
| AD-240091.1 | 53.6 | 4.7 |
| AD-240108.1 | 29.4 | 1.9 |
| AD-240117.1 | 85.3 | 10.6 |
| AD-240124.1 | 78.2 | 7.7 |
| AD-240125.1 | 82.3 | 17.8 |
| AD-240126.1 | 56.2 | 2.0 |
| AD-240135.1 | 33.4 | 13.3 |
| AD-240138.1 | 35.3 | 4.7 |
| AD-240140.1 | 12.7 | 3.5 |
| AD-240142.1 | 15.9 | 3.9 |
| AD-240145.1 | 15.1 | 1.1 |

TABLE 4-continued

HSD17B13 in vitro 50 nM screen in Cos-7
(Dual-Luciferase psiCHECK2 vector)

| Duplex Name | % of Human Message Remaining 50 nM | STDEV 50 nM |
|---|---|---|
| AD-240147.1 | 24.6 | 3.7 |
| AD-240148.1 | 18.9 | 4.5 |
| AD-240154.1 | 62.0 | 4.5 |
| AD-240155.1 | 24.9 | 5.6 |
| AD-240156.1 | 22.8 | 5.7 |
| AD-240171.1 | 28.6 | 5.1 |
| AD-240172.1 | 36.6 | 5.3 |
| AD-240192.1 | 32.6 | 3.8 |
| AD-240227.1 | 54.8 | 10.6 |
| AD-240228.1 | 51.8 | 10.9 |
| AD-240237.1 | 44.2 | 10.9 |
| AD-240245.1 | 85.3 | 14.5 |
| AD-240276.1 | 27.6 | 5.2 |
| AD-240278.1 | 16.7 | 2.8 |
| AD-240279.1 | 16.6 | 7.6 |
| AD-240280.1 | 13.2 | 3.3 |
| AD-240308.1 | 40.6 | 5.6 |
| AD-240309.1 | 59.7 | 8.3 |
| AD-240310.1 | 43.0 | 15.0 |
| AD-240311.1 | 85.9 | 12.1 |
| AD-240312.1 | 58.6 | 8.7 |
| AD-240313.1 | 32.1 | 2.0 |
| AD-240315.1 | 36.0 | 6.5 |
| AD-240317.1 | 28.0 | 1.8 |
| AD-240318.1 | 18.9 | 2.2 |
| AD-240319.1 | 49.2 | 4.4 |
| AD-240322.1 | 47.2 | 7.2 |
| AD-240324.1 | 31.4 | 1.6 |
| AD-240326.1 | 21.3 | 3.6 |
| AD-240327.1 | 24.9 | 5.4 |
| AD-240333.1 | 12.0 | 2.4 |
| AD-240364.1 | 57.4 | 7.4 |
| AD-240365.1 | 92.1 | 2.3 |
| AD-240375.1 | 97.7 | 21.7 |
| AD-240378.1 | 41.5 | 5.6 |
| AD-240381.1 | 22.4 | 7.1 |
| AD-240382.1 | 22.5 | 5.9 |
| AD-240383.1 | 27.0 | 3.2 |
| AD-240385.1 | 23.2 | 4.1 |
| AD-240386.1 | 29.9 | 3.4 |
| AD-240387.1 | 45.7 | 5.2 |
| AD-240419.1 | 76.4 | 17.2 |
| AD-240420.1 | 50.1 | 8.4 |
| AD-240421.1 | 40.9 | 6.3 |
| AD-240422.1 | 44.9 | 11.0 |
| AD-240423.1 | 30.4 | 6.5 |
| AD-240431.1 | 28.7 | 3.5 |
| AD-240446.1 | 13.9 | 1.7 |
| AD-240474.1 | 41.8 | 5.0 |
| AD-240475.1 | 70.9 | 15.3 |
| AD-240476.1 | 15.7 | 3.4 |
| AD-240490.1 | 27.9 | 6.3 |
| AD-240494.1 | 13.8 | 4.5 |
| AD-240495.1 | 19.6 | 0.9 |
| AD-240501.1 | 47.6 | 5.9 |
| AD-240502.1 | 18.7 | 3.8 |
| AD-240503.1 | 19.6 | 7.0 |
| AD-240504.1 | 17.2 | 2.6 |
| AD-240505.1 | 18.3 | 3.4 |
| AD-240507.1 | 23.8 | 3.3 |
| AD-240512.1 | 24.6 | 2.4 |
| AD-240513.1 | 70.6 | 9.0 |
| AD-240514.1 | 22.4 | 3.1 |
| AD-240538.1 | 40.7 | 4.2 |
| AD-240540.1 | 46.7 | 8.3 |
| AD-240542.1 | 21.1 | 4.0 |
| AD-240545.1 | 26.7 | 4.4 |
| AD-240546.1 | 35.2 | 3.1 |
| AD-240779.1 | 31.2 | 4.4 |
| AD-240782.1 | 27.9 | 2.8 |
| AD-240787.1 | 27.4 | 4.6 |
| AD-240788.1 | 16.9 | 3.9 |
| AD-240789.1 | 32.5 | 2.9 |
| AD-240790.1 | 18.9 | 5.1 |
| AD-240792.1 | 28.4 | 9.9 |
| AD-240793.1 | 22.4 | 1.9 |
| AD-240794.1 | 13.9 | 1.1 |
| AD-240795.1 | 25.9 | 5.2 |
| AD-240826.1 | 15.2 | 1.9 |
| AD-240830.1 | 32.1 | 7.2 |
| AD-240833.1 | 25.1 | 5.0 |
| AD-240834.1 | 15.3 | 3.1 |
| AD-240837.1 | 29.2 | 5.8 |
| AD-240839.1 | 14.3 | 2.6 |
| AD-240843.1 | 8.4 | 1.75 |
| AD-240844.1 | 33.8 | 8.1 |
| AD-240871.1 | 18.9 | 3.2 |
| AD-240875.1 | 18.0 | 1.6 |

TABLE 5

HSD17B13 in vitro 50 nM screen in Primary Human Hepatocytes

| Duplex Name | % of Human Message Remaining 50 nM | STDEV 50 nM |
|---|---|---|
| AD-238911.1 | 116.8 | 40.6 |
| AD-238912.1 | 83.9 | 15.4 |
| AD-238913.1 | 96.3 | 14.1 |
| AD-238929.1 | 82.9 | 14.7 |
| AD-238930.1 | 86.4 | 6.6 |
| AD-238932.1 | 72.4 | 23.3 |
| AD-238960.1 | 64.8 | 28.2 |
| AD-238979.1 | 48.1 | 25.1 |
| AD-238991.1 | 31.3 | 7.3 |
| AD-239009.1 | 34.1 | 9.3 |
| AD-239015.1 | 90.4 | 15.8 |
| AD-239016.1 | 51.7 | 13.0 |
| AD-239017.1 | 31.8 | 10.1 |
| AD-239018.1 | 75.5 | 16.0 |
| AD-239019.1 | 56.0 | 22.6 |
| AD-239020.1 | 59.9 | 19.3 |
| AD-239031.1 | 46.6 | 17.3 |
| AD-239062.1 | 61.9 | 21.9 |
| AD-239066.1 | 61.1 | 17.3 |
| AD-239103.1 | 41.0 | 21.7 |
| AD-239110.1 | 31.8 | 7.7 |
| AD-239118.1 | 48.3 | 3.7 |
| AD-239119.1 | 56.2 | 12.7 |
| AD-239131.1 | 75.2 | 18.1 |
| AD-239132.1 | 90.1 | 34.9 |
| AD-239133.1 | 52.0 | 10.7 |
| AD-239146.1 | 72.1 | 35.4 |
| AD-239155.1 | 39.1 | 9.8 |
| AD-239156.1 | 79.3 | 24.4 |
| AD-239177.1 | 55.1 | 15.6 |
| AD-239178.1 | 72.0 | 21.4 |
| AD-239179.1 | 57.8 | 10.5 |
| AD-239180.1 | 36.3 | 8.4 |
| AD-239181.1 | 60.6 | 19.7 |
| AD-239182.1 | 42.4 | 6.4 |
| AD-239183.1 | 29.3 | 13.1 |
| AD-239185.1 | 68.4 | 21.1 |
| AD-239186.1 | 87.7 | 23.4 |
| AD-239187.1 | 83.2 | 14.4 |
| AD-239188.1 | 54.2 | 13.2 |
| AD-239189.1 | 74.5 | 31.3 |
| AD-239190.1 | 57.4 | 3.5 |
| AD-239191.1 | 49.8 | 21.9 |
| AD-239192.1 | 33.9 | 13.5 |
| AD-239193.1 | 96.3 | 36.6 |
| AD-239194.1 | 63.1 | 18.3 |

TABLE 5-continued

HSD17B13 in vitro 50 nM screen in Primary Human Hepatocytes

| Duplex Name | % of Human Message Remaining 50 nM | STDEV 50 nM |
|---|---|---|
| AD-239196.1 | 43.5 | 11.6 |
| AD-239198.1 | 93.8 | 8.0 |
| AD-239199.1 | 44.2 | 21.5 |
| AD-239203.1 | 68.2 | 19.0 |
| AD-239214.1 | 40.3 | 8.3 |
| AD-239215.1 | 71.6 | 25.3 |
| AD-239239.1 | 53.9 | 32.4 |
| AD-239240.1 | 23.8 | 6.5 |
| AD-239241.1 | 56.2 | 10.0 |
| AD-239242.1 | 46.0 | 15.0 |
| AD-239243.1 | 97.6 | 73.4 |
| AD-239245.1 | 84.7 | 9.2 |
| AD-239246.1 | 37.6 | 11.2 |
| AD-239247.1 | 36.5 | 15.9 |
| AD-239250.1 | 34.1 | 6.8 |
| AD-239251.1 | 19.3 | 3.7 |
| AD-239253.1 | 26.3 | 6.9 |
| AD-239254.1 | 52.5 | 13.7 |
| AD-239255.1 | 52.8 | 18.1 |
| AD-239290.1 | 46.3 | 30.0 |
| AD-239291.1 | 53.1 | 25.1 |
| AD-239292.1 | 49.8 | 18.6 |
| AD-239293.1 | 49.5 | 15.6 |
| AD-239304.1 | 32.9 | 10.3 |
| AD-239312.1 | 83.1 | 13.5 |
| AD-239313.1 | 57.4 | 16.5 |
| AD-239314.1 | 85.7 | 13.7 |
| AD-239316.1 | 50.9 | 32.4 |
| AD-239317.1 | 28.0 | 3.5 |
| AD-239318.1 | 64.4 | 26.9 |
| AD-239321.1 | 34.8 | 6.9 |
| AD-239332.1 | 42.0 | 13.9 |
| AD-239337.1 | 29.1 | 11.0 |
| AD-239348.1 | 22.5 | 10.5 |
| AD-239362.1 | 67.8 | 29.4 |
| AD-239366.1 | 67.1 | 26.2 |
| AD-239368.1 | 41.2 | 17.8 |
| AD-239372.1 | 46.4 | 6.0 |
| AD-239373.1 | 27.8 | 4.1 |
| AD-239379.1 | 19.4 | 5.7 |
| AD-239380.1 | 26.5 | 9.0 |
| AD-239387.1 | 30.5 | 14.6 |
| AD-239397.1 | 18.9 | 5.4 |
| AD-239411.1 | 41.8 | 17.0 |
| AD-239412.1 | 79.2 | 22.8 |
| AD-239431.1 | 39.5 | 15.3 |
| AD-239433.1 | 36.9 | 12.1 |
| AD-239436.1 | 101.1 | 17.3 |
| AD-239437.1 | 37.6 | 20.8 |
| AD-239438.1 | 54.0 | 9.7 |
| AD-239439.1 | 31.8 | 6.5 |
| AD-239450.1 | 67.0 | 22.6 |
| AD-239451.1 | 42.4 | 15.3 |
| AD-239452.1 | 57.4 | 3.0 |
| AD-239453.1 | 45.9 | 5.9 |
| AD-239475.1 | 27.2 | 5.0 |
| AD-239476.1 | 41.4 | 16.7 |
| AD-239478.1 | 38.7 | 5.7 |
| AD-239479.1 | 44.0 | 19.6 |
| AD-239480.1 | 49.2 | 10.7 |
| AD-239482.1 | 31.6 | 9.4 |
| AD-239483.1 | 37.5 | 8.3 |
| AD-239499.1 | 56.0 | 12.2 |
| AD-239510.1 | 51.1 | 20.1 |
| AD-239520.1 | 26.5 | 15.5 |
| AD-239521.1 | 33.4 | 19.0 |
| AD-239522.1 | 36.2 | 18.2 |
| AD-239534.1 | 30.7 | 17.4 |
| AD-239539.1 | 76.9 | 31.7 |
| AD-239544.1 | 21.3 | 10.9 |
| AD-239566.1 | 39.1 | 8.1 |
| AD-239578.1 | 19.9 | 12.4 |
| AD-239579.1 | 24.7 | 6.7 |
| AD-239611.1 | 38.8 | 34.7 |
| AD-239612.1 | 60.9 | 15.4 |
| AD-239613.1 | 76.4 | 15.6 |
| AD-239617.1 | 186.1 | 52.1 |
| AD-239618.1 | 32.0 | 5.2 |
| AD-239637.1 | 22.8 | 2.8 |
| AD-239641.1 | 35.9 | 14.0 |
| AD-239642.1 | 31.5 | 28.5 |
| AD-239643.1 | 12.0 | 1.7 |
| AD-239645.1 | 29.6 | 11.6 |
| AD-239647.1 | 24.9 | 7.3 |
| AD-239649.1 | 35.0 | 4.2 |
| AD-239650.1 | 51.2 | 3.7 |
| AD-239653.1 | 48.8 | 26.5 |
| AD-239654.1 | 105.2 | 35.2 |
| AD-239662.1 | 27.5 | 12.0 |
| AD-239668.1 | 31.5 | 9.1 |
| AD-239669.1 | 42.4 | 24.3 |
| AD-239670.1 | 53.3 | 17.1 |
| AD-239671.1 | 26.2 | 11.1 |
| AD-239674.1 | 17.3 | 9.5 |
| AD-239676.1 | 42.1 | 13.1 |
| AD-239681.1 | 24.9 | 11.4 |
| AD-239682.1 | 12.7 | 4.5 |
| AD-239684.1 | 15.2 | 1.4 |
| AD-239685.1 | 24.9 | 6.1 |
| AD-239697.1 | 15.1 | 6.2 |
| AD-239713.1 | 24.6 | 7.4 |
| AD-239714.1 | 23.6 | 18.1 |
| AD-239717.1 | 36.6 | 33.7 |
| AD-239721.1 | 7.3 | 3.4 |
| AD-239723.1 | 47.2 | 12.1 |
| AD-239724.1 | 29.1 | 7.8 |
| AD-239725.1 | 17.7 | 15.4 |
| AD-239726.1 | 45.9 | 13.2 |
| AD-239755.1 | 19.0 | 4.6 |
| AD-239757.1 | 28.6 | 3.2 |
| AD-239759.1 | 10.7 | 3.3 |
| AD-239761.1 | 60.2 | 11.2 |
| AD-239764.1 | 56.4 | 15.6 |
| AD-239778.1 | 45.9 | 32.9 |
| AD-239779.1 | 18.2 | 12.0 |
| AD-239780.1 | 34.5 | 22.1 |
| AD-239781.1 | 30.1 | 16.8 |
| AD-239782.1 | 37.3 | 12.4 |
| AD-239783.1 | 13.0 | 6.8 |
| AD-239784.1 | 43.1 | 14.0 |
| AD-239785.1 | 9.9 | 8.9 |
| AD-239786.1 | 16.9 | 10.0 |
| AD-239787.1 | 15.9 | 9.3 |
| AD-239791.1 | 11.7 | 5.4 |
| AD-239793.1 | 11.1 | 3.2 |
| AD-239806.1 | 29.4 | 13.5 |
| AD-239839.1 | 60.6 | 13.8 |
| AD-239840.1 | 36.7 | 23.2 |
| AD-239854.1 | 39.0 | 20.3 |
| AD-239855.1 | 31.6 | 5.2 |
| AD-239876.1 | 34.6 | 10.8 |
| AD-239877.1 | 35.8 | 21.8 |
| AD-239881.1 | 47.0 | 11.9 |
| AD-239905.1 | 36.6 | 8.2 |
| AD-239914.1 | 30.4 | 13.9 |
| AD-239915.1 | 51.3 | 25.7 |
| AD-239941.1 | 111.8 | 60.8 |
| AD-239944.1 | 63.6 | 23.9 |
| AD-239945.1 | 58.6 | 23.0 |
| AD-239946.1 | 65.3 | 28.6 |
| AD-239947.1 | 77.7 | 16.6 |
| AD-239977.1 | 54.5 | 16.5 |
| AD-239979.1 | 61.4 | 14.4 |
| AD-239980.1 | 87.8 | 41.2 |
| AD-239998.1 | 54.8 | 14.7 |
| AD-240019.1 | 76.7 | 23.6 |
| AD-240031.1 | 63.1 | 18.5 |
| AD-240032.1 | 51.6 | 13.5 |

TABLE 5-continued

HSD17B13 in vitro 50 nM screen in Primary Human Hepatocytes

| Duplex Name | % of Human Message Remaining 50 nM | STDEV 50 nM |
|---|---|---|
| AD-240033.1 | 69.7 | 41.4 |
| AD-240064.1 | 81.0 | 32.4 |
| AD-240090.1 | 145.8 | 80.6 |
| AD-240091.1 | 75.2 | 17.1 |
| AD-240108.1 | 62.2 | 18.9 |
| AD-240117.1 | 54.4 | 2.3 |
| AD-240124.1 | 63.3 | 25.7 |
| AD-240125.1 | 68.6 | 18.1 |
| AD-240126.1 | 77.4 | 10.9 |
| AD-240135.1 | 64.9 | 33.1 |
| AD-240138.1 | 59.3 | 17.7 |
| AD-240140.1 | 65.2 | 21.2 |
| AD-240142.1 | 42.9 | 6.6 |
| AD-240145.1 | 58.2 | 10.2 |
| AD-240147.1 | 56.7 | 14.3 |
| AD-240148.1 | 35.0 | 12.2 |
| AD-240154.1 | 39.2 | 19.5 |
| AD-240155.1 | 57.2 | 22.1 |
| AD-240156.1 | 71.9 | 28.3 |
| AD-240171.1 | 66.4 | 22.8 |
| AD-240172.1 | 50.4 | 12.9 |
| AD-240192.1 | 43.5 | 3.8 |
| AD-240227.1 | 62.1 | 19.7 |
| AD-240228.1 | 50.6 | 12.7 |
| AD-240237.1 | 67.2 | 9.5 |
| AD-240245.1 | 99.3 | 21.4 |
| AD-240276.1 | 49.9 | 16.6 |
| AD-240278.1 | 31.8 | 6.1 |
| AD-240279.1 | 46.2 | 2.4 |
| AD-240280.1 | 68.4 | 16.4 |
| AD-240308.1 | 72.7 | 15.4 |
| AD-240309.1 | 85.8 | 2.0 |
| AD-240310.1 | 58.9 | 16.1 |
| AD-240311.1 | 74.2 | 21.0 |
| AD-240312.1 | 83.3 | 7.3 |
| AD-240313.1 | 70.4 | 15.1 |
| AD-240315.1 | 66.1 | 7.6 |
| AD-240317.1 | 52.0 | 11.1 |
| AD-240318.1 | 65.1 | 24.1 |
| AD-240319.1 | 38.8 | 7.7 |
| AD-240322.1 | 69.9 | 10.1 |
| AD-240324.1 | 79.6 | 37.5 |
| AD-240326.1 | 29.8 | 3.0 |
| AD-240327.1 | 62.6 | 11.3 |
| AD-240333.1 | 60.3 | 31.5 |
| AD-240364.1 | 81.0 | 16.8 |
| AD-240365.1 | 104.1 | 31.5 |
| AD-240375.1 | 111.2 | 18.0 |
| AD-240378.1 | 85.1 | 33.8 |
| AD-240381.1 | 87.8 | 18.3 |
| AD-240382.1 | 51.9 | 9.5 |
| AD-240383.1 | 45.6 | 13.2 |
| AD-240385.1 | 53.5 | 6.6 |
| AD-240386.1 | 63.3 | 6.8 |
| AD-240387.1 | 75.8 | 26.0 |
| AD-240419.1 | 81.2 | 11.1 |
| AD-240420.1 | 69.3 | 32.6 |
| AD-240421.1 | 93.8 | 17.0 |
| AD-240422.1 | 75.6 | 38.5 |
| AD-240423.1 | 75.7 | 14.1 |
| AD-240431.1 | 53.2 | 2.4 |
| AD-240446.1 | 93.2 | 30.6 |
| AD-240474.1 | 74.7 | 22.8 |
| AD-240475.1 | 74.4 | 29.5 |
| AD-240476.1 | 37.2 | 2.4 |
| AD-240490.1 | 82.0 | 34.8 |
| AD-240494.1 | 62.3 | 14.1 |
| AD-240495.1 | 102.5 | 39.4 |
| AD-240501.1 | 33.9 | 4.9 |
| AD-240502.1 | 40.6 | 5.7 |
| AD-240503.1 | 63.4 | 31.4 |
| AD-240504.1 | 55.0 | 7.7 |
| AD-240505.1 | 73.0 | 22.1 |
| AD-240507.1 | 68.3 | 23.1 |

TABLE 5-continued

HSD17B13 in vitro 50 nM screen in Primary Human Hepatocytes

| Duplex Name | % of Human Message Remaining 50 nM | STDEV 50 nM |
|---|---|---|
| AD-240512.1 | 55.0 | 19.6 |
| AD-240513.1 | 54.9 | 14.8 |
| AD-240514.1 | 33.8 | 16.7 |
| AD-240538.1 | 51.3 | 13.3 |
| AD-240540.1 | 72.1 | 11.2 |
| AD-240542.1 | 60.0 | 9.0 |
| AD-240545.1 | 45.9 | 23.8 |
| AD-240546.1 | 46.2 | 18.4 |
| AD-240779.1 | 64.8 | 22.4 |
| AD-240782.1 | 77.7 | 20.3 |
| AD-240787.1 | 59.6 | 16.9 |
| AD-240788.1 | 54.2 | 12.0 |
| AD-240789.1 | 58.9 | 24.6 |
| AD-240790.1 | 54.0 | 14.7 |
| AD-240792.1 | 67.2 | 9.2 |
| AD-240793.1 | 54.9 | 14.6 |
| AD-240794.1 | 69.3 | 18.8 |
| AD-240795.1 | 34.5 | 7.2 |
| AD-240826.1 | 56.5 | 16.8 |
| AD-240830.1 | 63.7 | 14.4 |
| AD-240833.1 | 84.9 | 28.4 |
| AD-240834.1 | 50.2 | 15.1 |
| AD-240837.1 | 46.3 | 16.3 |
| AD-240839.1 | 54.9 | 18.4 |
| AD-240843.1 | 46.4 | 13.9 |
| AD-240844.1 | 38.2 | 10.3 |
| AD-240871.1 | 92.8 | 35.8 |
| AD-240875.1 | 72.0 | 13.2 |

TABLE 6

HSD17B13 in vitro 50 nM screen in Primary Cynomolgus Hepatocytes

| Duplex Name | % of Cyno Message Remaining 50 nM | STDEV 50 nM |
|---|---|---|
| AD-238911.1 | 81.2 | 8.9 |
| AD-238912.1 | 87.5 | 6.8 |
| AD-238913.1 | 62.3 | 4.1 |
| AD-238929.1 | 67.1 | 22.3 |
| AD-238930.1 | 42.1 | 4.0 |
| AD-238932.1 | 54.8 | 12.2 |
| AD-238960.1 | 24.6 | 5.2 |
| AD-238979.1 | 11.1 | 7.5 |
| AD-238991.1 | 30.8 | 6.2 |
| AD-239009.1 | 11.4 | 1.1 |
| AD-239015.1 | 21.2 | 3.0 |
| AD-239016.1 | 7.2 | 1.4 |
| AD-239017.1 | 8.9 | 1.8 |
| AD-239018.1 | 39.2 | 4.6 |
| AD-239019.1 | 22.0 | 5.5 |
| AD-239020.1 | 8.8 | 2.8 |
| AD-239031.1 | 19.5 | 7.5 |
| AD-239062.1 | 20.6 | 5.6 |
| AD-239066.1 | 75.5 | 16.3 |
| AD-239103.1 | 88.4 | 33.4 |
| AD-239110.1 | 11.2 | 3.0 |
| AD-239118.1 | 23.1 | 6.3 |
| AD-239119.1 | 23.4 | 4.2 |
| AD-239131.1 | 98.9 | 9.0 |
| AD-239132.1 | 86.0 | 18.5 |
| AD-239133.1 | 24.3 | 8.7 |
| AD-239146.1 | 11.4 | 2.8 |
| AD-239155.1 | 39.4 | 21.3 |
| AD-239156.1 | 52.8 | 11.0 |
| AD-239177.1 | 23.1 | 6.7 |
| AD-239178.1 | 46.3 | 4.6 |
| AD-239179.1 | 40.3 | 8.7 |
| AD-239180.1 | 21.8 | 6.2 |
| AD-239181.1 | 45.5 | 5.9 |

TABLE 6-continued

HSD17B13 in vitro 50 nM screen in Primary Cynomolgus Hepatocytes

| Duplex Name | % of Cyno Message Remaining 50 nM | STDEV 50 nM |
|---|---|---|
| AD-239182.1 | 17.7 | 3.8 |
| AD-239183.1 | 10.6 | 1.5 |
| AD-239185.1 | 55.9 | 7.2 |
| AD-239186.1 | 77.7 | 13.0 |
| AD-239187.1 | 61.1 | 6.8 |
| AD-239188.1 | 41.0 | 1.5 |
| AD-239189.1 | 11.6 | 2.1 |
| AD-239190.1 | 48.8 | 7.9 |
| AD-239191.1 | 9.0 | 4.1 |
| AD-239192.1 | 35.0 | 12.1 |
| AD-239193.1 | 68.1 | 4.9 |
| AD-239194.1 | 26.7 | 1.7 |
| AD-239196.1 | 56.6 | 10.2 |
| AD-239198.1 | 80.5 | 11.0 |
| AD-239199.1 | 32.8 | 4.6 |
| AD-239203.1 | 36.9 | 6.3 |
| AD-239214.1 | 15.3 | 2.7 |
| AD-239215.1 | 28.9 | 6.5 |
| AD-239239.1 | 17.0 | 2.8 |
| AD-239240.1 | 15.6 | 4.4 |
| AD-239241.1 | 16.8 | 9.9 |
| AD-239242.1 | 16.5 | 5.9 |
| AD-239243.1 | 13.3 | 4.2 |
| AD-239245.1 | 13.7 | 2.9 |
| AD-239246.1 | 12.9 | 8.2 |
| AD-239247.1 | 18.0 | 6.5 |
| AD-239250.1 | 49.8 | 6.5 |
| AD-239251.1 | 6.8 | 0.5 |
| AD-239253.1 | 11.5 | 3.8 |
| AD-239254.1 | 47.4 | 4.6 |
| AD-239255.1 | 16.4 | 7.2 |
| AD-239290.1 | 75.5 | 25.9 |
| AD-239291.1 | 92.3 | 27.1 |
| AD-239292.1 | 9.8 | 2.7 |
| AD-239293.1 | 46.8 | 6.3 |
| AD-239304.1 | 30.7 | 8.9 |
| AD-239312.1 | 15.0 | 3.2 |
| AD-239313.1 | 8.7 | 2.4 |
| AD-239314.1 | 100.1 | 18.8 |
| AD-239316.1 | 40.0 | 9.5 |
| AD-239317.1 | 12.3 | 2.0 |
| AD-239318.1 | 9.3 | 1.8 |
| AD-239321.1 | 9.2 | 2.4 |
| AD-239332.1 | 48.0 | 12.4 |
| AD-239337.1 | 15.4 | 7.5 |
| AD-239348.1 | 21.1 | 6.0 |
| AD-239362.1 | 75.3 | 6.7 |
| AD-239366.1 | 30.7 | 11.1 |
| AD-239368.1 | 24.6 | 6.2 |
| AD-239372.1 | 45.5 | 2.7 |
| AD-239373.1 | 33.3 | 7.5 |
| AD-239379.1 | 8.1 | 2.6 |
| AD-239380.1 | 7.2 | 1.1 |
| AD-239387.1 | 36.2 | 5.3 |
| AD-239397.1 | 12.3 | 3.4 |
| AD-239411.1 | 31.6 | 10.7 |
| AD-239412.1 | 59.5 | 7.0 |
| AD-239431.1 | 13.2 | 7.9 |
| AD-239433.1 | 33.0 | 10.1 |
| AD-239436.1 | 71.5 | 14.7 |
| AD-239437.1 | 10.4 | 2.6 |
| AD-239438.1 | 12.3 | 2.7 |
| AD-239439.1 | 79.2 | 11.8 |
| AD-239450.1 | 61.3 | 2.2 |
| AD-239451.1 | 29.7 | 8.7 |
| AD-239452.1 | 78.7 | 17.3 |
| AD-239453.1 | 38.5 | 10.6 |
| AD-239475.1 | 11.4 | 2.2 |
| AD-239476.1 | 39.5 | 6.9 |
| AD-239478.1 | 59.3 | 9.4 |
| AD-239479.1 | 14.7 | 3.6 |
| AD-239480.1 | 31.6 | 6.6 |
| AD-239482.1 | 13.7 | 3.3 |
| AD-239483.1 | 14.1 | 3.8 |
| AD-239499.1 | 111.5 | 13.7 |
| AD-239510.1 | 16.0 | 4.0 |
| AD-239520.1 | 11.3 | 5.2 |
| AD-239521.1 | 19.8 | 3.7 |
| AD-239522.1 | 12.5 | 3.8 |
| AD-239534.1 | 31.1 | 8.4 |
| AD-239539.1 | 9.3 | 3.5 |
| AD-239544.1 | 24.0 | 3.2 |
| AD-239566.1 | 11.9 | 7.0 |
| AD-239578.1 | 25.7 | 5.5 |
| AD-239579.1 | 28.1 | 5.9 |
| AD-239611.1 | 37.4 | 7.8 |
| AD-239612.1 | 36.2 | 8.4 |
| AD-239613.1 | 13.5 | 3.3 |
| AD-239617.1 | 46.2 | 9.3 |
| AD-239618.1 | 15.9 | 1.2 |
| AD-239637.1 | 33.6 | 13.4 |
| AD-239641.1 | 42.3 | 7.4 |
| AD-239642.1 | 34.4 | 5.7 |
| AD-239643.1 | 9.7 | 2.0 |
| AD-239645.1 | 16.1 | 3.4 |
| AD-239647.1 | 19.0 | 4.0 |
| AD-239649.1 | 70.4 | 6.0 |
| AD-239650.1 | 65.8 | 12.5 |
| AD-239653.1 | 16.4 | 3.6 |
| AD-239654.1 | 18.3 | 6.5 |
| AD-239662.1 | 8.4 | 4.1 |
| AD-239668.1 | 13.2 | 4.2 |
| AD-239669.1 | 53.6 | 14.0 |
| AD-239670.1 | 14.4 | 3.6 |
| AD-239671.1 | 12.1 | 2.9 |
| AD-239674.1 | 14.8 | 4.0 |
| AD-239676.1 | 20.9 | 4.8 |
| AD-239681.1 | 9.4 | 0.6 |
| AD-239682.1 | 8.9 | 1.3 |
| AD-239684.1 | 12.0 | 2.9 |
| AD-239685.1 | 10.8 | 3.7 |
| AD-239697.1 | 11.8 | 3.3 |
| AD-239713.1 | 11.4 | 1.8 |
| AD-239714.1 | 7.8 | 2.8 |
| AD-239717.1 | 10.4 | 1.5 |
| AD-239721.1 | 27.2 | 6.4 |
| AD-239723.1 | 81.2 | 14.9 |
| AD-239724.1 | 11.0 | 3.7 |
| AD-239725.1 | 24.1 | 3.0 |
| AD-239726.1 | 27.3 | 7.7 |
| AD-239755.1 | 7.8 | 3.3 |
| AD-239757.1 | 30.3 | 3.4 |
| AD-239759.1 | 6.7 | 1.7 |
| AD-239761.1 | 49.7 | 11.8 |
| AD-239764.1 | 53.5 | 11.4 |
| AD-239778.1 | 26.8 | 7.8 |
| AD-239779.1 | 63.3 | 20.5 |
| AD-239780.1 | 85.5 | 17.8 |
| AD-239781.1 | 26.4 | 6.0 |
| AD-239782.1 | 22.6 | 6.7 |
| AD-239783.1 | 9.7 | 1.9 |
| AD-239784.1 | 20.2 | 3.8 |
| AD-239785.1 | 23.6 | 6.7 |
| AD-239786.1 | 38.3 | 6.1 |
| AD-239787.1 | 27.6 | 2.5 |
| AD-239791.1 | 17.8 | 2.1 |
| AD-239793.1 | 6.8 | 1.2 |
| AD-239806.1 | 27.8 | 2.9 |
| AD-239839.1 | 11.9 | 5.6 |
| AD-239840.1 | 10.3 | 1.8 |
| AD-239854.1 | 58.6 | 8.9 |
| AD-239855.1 | 23.3 | 9.3 |
| AD-239876.1 | 42.8 | 20.3 |
| AD-239877.1 | 30.6 | 10.4 |
| AD-239881.1 | 53.4 | 5.5 |
| AD-239905.1 | 50.1 | 17.6 |
| AD-239914.1 | 37.3 | 5.2 |
| AD-239915.1 | 34.8 | 5.7 |

TABLE 6-continued

HSD17B13 in vitro 50 nM screen in Primary Cynomolgus Hepatocytes

| Duplex Name | % of Cyno Message Remaining 50 nM | STDEV 50 nM |
|---|---|---|
| AD-239941.1 | 66.8 | 14.1 |
| AD-239944.1 | 117.7 | 12.5 |
| AD-239945.1 | 23.2 | 2.7 |
| AD-239946.1 | 14.0 | 5.9 |
| AD-239947.1 | 25.8 | 1.6 |
| AD-239977.1 | 27.3 | 4.4 |
| AD-239979.1 | 25.5 | 4.8 |
| AD-239980.1 | 35.5 | 6.4 |
| AD-239998.1 | 32.7 | 4.0 |
| AD-240019.1 | 17.9 | 2.6 |
| AD-240031.1 | 15.3 | 1.9 |
| AD-240032.1 | 23.4 | 2.4 |
| AD-240033.1 | 22.2 | 3.7 |
| AD-240064.1 | 47.1 | 5.2 |
| AD-240090.1 | 25.7 | 5.9 |
| AD-240091.1 | 31.4 | 8.2 |
| AD-240108.1 | 118.3 | 27.0 |
| AD-240117.1 | 56.6 | 5.6 |
| AD-240124.1 | 43.5 | 8.1 |
| AD-240125.1 | 54.0 | 6.8 |
| AD-240126.1 | 30.7 | 7.0 |
| AD-240135.1 | 14.7 | 0.8 |
| AD-240138.1 | 36.6 | 13.8 |
| AD-240140.1 | 33.6 | 10.9 |
| AD-240142.1 | 19.4 | 4.7 |
| AD-240145.1 | 27.6 | 9.1 |
| AD-240147.1 | 18.1 | 3.4 |
| AD-240148.1 | 9.0 | 1.7 |
| AD-240154.1 | 23.0 | 1.0 |
| AD-240155.1 | 18.2 | 1.7 |
| AD-240156.1 | 15.1 | 2.2 |
| AD-240171.1 | 29.9 | 6.9 |
| AD-240172.1 | 31.9 | 8.0 |
| AD-240192.1 | 39.7 | 5.7 |
| AD-240227.1 | 71.4 | 15.6 |
| AD-240228.1 | 35.8 | 22.3 |
| AD-240237.1 | 43.3 | 17.3 |
| AD-240245.1 | 41.5 | 5.1 |
| AD-240276.1 | 20.6 | 4.4 |
| AD-240278.1 | 11.6 | 1.8 |
| AD-240279.1 | 20.1 | 0.5 |
| AD-240280.1 | 51.0 | 9.5 |
| AD-240308.1 | 80.5 | 19.3 |
| AD-240309.1 | 63.5 | 10.3 |
| AD-240310.1 | 45.2 | 10.3 |
| AD-240311.1 | 42.6 | 14.8 |
| AD-240312.1 | 22.3 | 1.3 |
| AD-240313.1 | 21.6 | 4.5 |
| AD-240315.1 | 26.4 | 8.2 |
| AD-240317.1 | 17.8 | 3.6 |
| AD-240318.1 | 20.5 | 2.5 |
| AD-240319.1 | 23.5 | 6.5 |
| AD-240322.1 | 37.5 | 2.7 |
| AD-240324.1 | 37.1 | 13.9 |
| AD-240326.1 | 11.2 | 3.4 |
| AD-240327.1 | 28.7 | 4.0 |
| AD-240333.1 | 32.0 | 5.8 |
| AD-240364.1 | 34.1 | 13.5 |
| AD-240365.1 | 58.8 | 18.7 |
| AD-240375.1 | 86.7 | 17.8 |
| AD-240378.1 | 49.8 | 14.8 |
| AD-240381.1 | 56.0 | 12.0 |
| AD-240382.1 | 35.7 | 7.9 |
| AD-240383.1 | 27.5 | 5.5 |
| AD-240385.1 | 15.8 | 2.0 |
| AD-240386.1 | 18.7 | 2.0 |
| AD-240387.1 | 33.3 | 13.0 |
| AD-240419.1 | 32.8 | 4.2 |
| AD-240420.1 | 31.5 | 4.5 |
| AD-240421.1 | 21.5 | 4.7 |
| AD-240422.1 | 19.9 | 4.6 |
| AD-240423.1 | 13.1 | 2.3 |
| AD-240431.1 | 16.1 | 3.3 |
| AD-240446.1 | 16.6 | 3.5 |
| AD-240474.1 | 28.7 | 10.8 |
| AD-240475.1 | 32.7 | 11.9 |
| AD-240476.1 | 11.0 | 1.8 |
| AD-240490.1 | 38.5 | 5.6 |
| AD-240494.1 | 37.3 | 14.0 |
| AD-240495.1 | 17.4 | 4.6 |
| AD-240501.1 | 29.5 | 6.7 |
| AD-240502.1 | 16.3 | 1.2 |
| AD-240503.1 | 12.4 | 2.5 |
| AD-240504.1 | 15.6 | 4.4 |
| AD-240505.1 | 44.8 | 15.3 |
| AD-240507.1 | 47.0 | 12.7 |
| AD-240512.1 | 31.9 | 3.9 |
| AD-240513.1 | 44.2 | 3.8 |
| AD-240514.1 | 13.0 | 2.4 |
| AD-240538.1 | 35.5 | 6.4 |
| AD-240540.1 | 40.0 | 12.4 |
| AD-240542.1 | 65.6 | 15.4 |
| AD-240545.1 | 18.7 | 2.3 |
| AD-240546.1 | 32.4 | 5.0 |
| AD-240779.1 | 33.8 | 8.0 |
| AD-240782.1 | 33.6 | 7.3 |
| AD-240787.1 | 35.4 | 3.4 |
| AD-240788.1 | 12.5 | 1.3 |
| AD-240789.1 | 42.6 | 8.0 |
| AD-240790.1 | 21.9 | 2.1 |
| AD-240792.1 | 22.0 | 2.8 |
| AD-240793.1 | 22.7 | 3.7 |
| AD-240794.1 | 37.5 | 9.5 |
| AD-240795.1 | 18.9 | 1.9 |
| AD-240826.1 | 38.9 | 6.9 |
| AD-240830.1 | 32.9 | 2.4 |
| AD-240833.1 | 41.6 | 9.4 |
| AD-240834.1 | 17.2 | 3.6 |
| AD-240837.1 | 42.1 | 7.9 |
| AD-240839.1 | 18.4 | 3.7 |
| AD-240843.1 | 17.1 | 5.9 |
| AD-240844.1 | 19.8 | 3.8 |
| AD-240871.1 | 16.2 | 2.1 |
| AD-240875.1 | 48.1 | 27.7 |

Example 2. iRNA Design, Synthesis, and Selection

This Example describes methods for the design, synthesis, and selection of additional HSD17B13 iRNA agents.

Bioinformatics

A set of siRNAs targeting the human hydroxysteroid 17-beta dehydrogenase 13 gene (HSD17B13; human NCBI refseqID NM_178135.4; NCBI GeneID: 345275) as well the toxicology-species HSD17B13 ortholog from cynomolgus monkey: XM_005555367.2 was designed using custom R and Python scripts. All the siRNA designs have a perfect match to the human HSD17B13 transcript and a subset either perfect or near-perfect matches to the cynomolgus monkey ortholog. The human NM_178135 REFSEQ mRNA, version 4, has a length of 2397 bases. The rationale and method for the set of siRNA designs is as follows: the predicted efficacy for every potential 23mer siRNA from position 10 through the end was determined with a random forest model derived from the direct measure of mRNA knockdown from several thousand distinct siRNA designs targeting a diverse set of vertebrate genes. For each strand of the siRNA, a custom Python script was used in a brute force search to measure the number and positions of mismatches between the siRNA and all potential alignments in the human transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8, 1.2, 1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human and cynomolgus monkey was >=2 and predicted efficacy was >=50% knockdown.

In Vitro Cos-7 (Dual-Luciferase psiCHECK2 Human HSD17B13 Vector) and Primary Cynomolgus Hepatocytes Screening Dual-Glo® Luciferase Assay Cos-7 cells (ATCC, Manassas, Va.) were grown to near confluence at 37° C. in an atmosphere of 5% $CO_2$ in DMEM (ATCC) supplemented with 10% FBS, before being released from the plate by trypsinization. Multi-dose experiments were performed at 10 nM and 0.1 nM. siRNA and psi-CHECK2-HSD17B13 (NM_178135 cloned into XhoI-NotI sites) plasmid transfection was carried out by adding 5 µl of siRNA duplexes and 5 µl (5 ng) of psiCHECK2-HSD17B13 plasmid per well along with 4.9 µl of Opti-MEM plus 0.1 µl of Lipofectamine 2000 per well (Invitrogen, Carlsbad Calif. cat #13778-150) and then incubated at room temperature for 15 minutes. The mixture was then added to the cells which were re-suspended in 35 µl of fresh complete media. The transfected cells were incubated at 37° C. in an atmosphere of 5% $CO_2$.

Forty-eight hours after the siRNAs and psiCHECK2-HSD17B13 plasmid were transfected; Firefly (transfection control) and *Renilla* (fused to HSD17B13 target sequence) luciferase were measured. First, media was removed from cells. Then Firefly luciferase activity was measured by adding 20 µl of Dual-Glo® Luciferase Reagent equal to the culture medium volume to each well and mixing. The mixture was incubated at room temperature for 30 minutes before luminescence (500 nm) was measured on a Spectramax (Molecular Devices) to detect the Firefly luciferase signal. 20 µl of room temperature Dual-Glo® Stop & Glo® Reagent was added to each well and the plates were incubated for 10-15 minutes before luminescence was again measured to determine the *Renilla* luciferase signal. The Dual-Glo® Stop & Glo® Reagent quenched the firefly luciferase signal and sustained luminescence for the *Renilla* luciferase reaction. siRNA activity was determined by normalizing the *Renilla* (HSD17B13) signal to the Firefly (control) signal within each well. The magnitude of siRNA activity was then assessed relative to cells that were transfected with the same vector but were not treated with siRNA or were treated with a non-targeting siRNA. All transfections were done at n=2 or greater.

Cell Culture and Transfections

Primary Cynomolgus Hepatocytes (Bioreclamation/IVT) were transfected by adding 4.9 µl of Opti-MEM plus 0.1 µl of RNAiMAX per well (Invitrogen, Carlsbad Calif. cat #13778-150) to 5 µl of siRNA duplexes per well, with 4 replicates of each SiRNA duplex, into a 384-well plate, and incubating the plate at room temperature for 15 minutes. 40 µl of InVitroGRO CP plating media (Bioreclamation/IVT) containing ~5×10³ cells were then added to the siRNA mixture. Cells were incubated for 48 hours prior to RNA purification. Multi-dose experiments were performed at 10 nM and 0.1 nM.

Total RNA Isolation Using DYNABEADS mRNA Isolation Kit

RNA was isolated using an automated protocol on a BioTek-EL406 platform using DYNABEADs (Invitrogen, cat #61012). Briefly, 70 µl of Lysis/Binding Buffer and 10 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and supernatant removed.

cDNA Synthesis Using ABI High Capacity cDNA Reverse Transcription Kit (Applied Biosystems. Foster City, Calif., Cat #4368813)

10 µl of a master mix containing 1 µl 10× Buffer, 0.4 µl 25×dNTPs, 1 µl 10× Random primers, 0.5 µl Reverse Transcriptase, 0.5 µl RNase inhibitor and 6.6 µl of $H_2O$ per reaction was added to RNA isolated above. Plates were sealed, mixed, and incubated on an electromagnetic shaker for 10 minutes at room temperature, followed by 2 h at 37° C.

Real time PCR

2 µl of cDNA were added to a master mix containing 0.5 µl of Cyno GAPDH TaqMan Probe (forward primer: 5'-GCATCCTGGGCTACACTGA-3' (SEQ ID NO: 4483), reverse primer: 5'-TGGGTGTCGCTGTTGAAGTC-3' (SEQ ID NO: 4484), probe: 5'HEX-CCAGGTGGTCTCCTCC-3'BHQ-1 (SEQ ID NO: 4485)), and 0.5 µl HSD17B13 cynomolgus probe (Mf02888851_m1) and 5 µl Lightcycler 480 probe master mix (Roche Cat #04887301001) per well in a 384-well plate (Roche cat #04887301001). Real time PCR was done in a LightCycler480 Real Time PCR system (Roche). Each duplex was tested at least two times and data were normalized to cells transfected with a non-targeting control siRNA. To calculate relative fold change, real time data were analyzed using the ΔΔCt method and normalized to assays performed with cells transfected with a non-targeting control siRNA.

Results

Table 7 provides HSD17B13 ELF7 GNA7 modified sequences. Table 8 provides HSD17B13 ELF7 GNA7 unmodified sequences. Results from the HSD17B13 ELF7 GNA7 modified sequences in vitro 10 nM screen in Cos-7 and primary cynomolgus hepatocytes are summarized in Table 9.

Similarly, Table 10 provides HSD17B13 NonF DNA modified sequences. Table 11 provides HSD17B13 NonF DNA unmodified sequences. Shown in Table 12 are results from the HSD17B13 NonF DNA modified sequences in vitro 10 nM screen in Cos-7 and primary cynomolgus hepatocytes. "NonF" indicates that these RNAi agents lack fluoro modifications.

TABLE 7

HSD17B13 ELF7 GNA7 Modified Sequence*

| Duplex Name | Sense sequence 5' to 3' | SEQ ID NO: | Antisense sequence 5' to 3' | SEQ ID NO: |
|---|---|---|---|---|
| AD-286958.1 | asgsuaccUfcCfUfCfccuaggacuaL96 | 2981 | usAfsgucc(Tgn)agggagGfaGfguacusgsu | 302 |
| AD-287001.1 | uscscuucUfgCfUfUfcugaucaccaL96 | 2982 | usGfsguga(Tgn)cagaagCfaGfaaggasusu | 303 |
| AD-287012.1 | csasucauCfuAfCfUfccuacuuggaL96 | 2983 | usCfscaag(Tgn)aggaguAfgAfugaugsgsu | 304 |
| AD-287014.1 | uscsuacuCfcUfAfCfuuggagucguL96 | 2984 | asCfsgacu(Cgn)caaguaGfgAfguagasusg | 305 |

TABLE 7-continued

HSD17B13 ELF7 GNA7 Modified Sequence*

| | | | | | |
|---|---|---|---|---|---|
| AD-287015.1 | csusacucCfuAfCfUfuggagucguuL96 | 2985 | asAfscgac(Tgn)ccaaguAfgGfaguagsasu | 306 |
| AD-287017.1 | gsusaccuCfcUfCfCfcuaggacuauL96 | 2986 | asUfsaguc(Cgn)uagggaGfgAfgguacsusg | 307 |
| AD-287026.1 | ascscaaGfgAfCfUfgaaccagaauL96 | 2987 | asUfsucug(Ggn)uucaguCfcUfugugusasg | 308 |
| AD-287059.1 | ascscaucAfuCfUfAfcuccuacuuuL96 | 2988 | asAfsagua(Ggn)gaguagAfuUfauggusgsa | 309 |
| AD-287060.1 | cscsaucaUfcUfAfCfuccuacuuguL96 | 2989 | asCfsaagu(Agn)ggaguaGfaUfgauggsusg | 310 |
| AD-287061.1 | asuscaucUfaCfUfCfcuacuuggauL96 | 2990 | asUfsccaa(Ggn)uaggagUfaUfaugausgsg | 311 |
| AD-287062.1 | csasucuaCfuCfCfUfacuuggaguuL96 | 2991 | asAfscucc(Agn)aguaggAfgUfagaugsasu | 312 |
| AD-287064.1 | usascuccUfaCfUfUfgggaucguuuL96 | 2992 | asAfsacga(Cgn)uccaagUfaGfgaguasgsa | 313 |
| AD-287065.1 | ascsuccuAfcUfUfGfgagucguugguL96 | 2993 | asCfsaacg(Agn)cuccaaGfuAfggagusasg | 314 |
| AD-287066.1 | csuscuctaCfuUfGfGfagucguuggguL96 | 2994 | asCfscaac(Ggn)acuccaAfgUfaggagsusa | 315 |
| AD-287126.1 | uscscuacUfuUfGfAfgucguuggguuL96 | 2995 | asAfsccaa(Cgn)gacuccAfaGfuaggasgsu | 316 |
| AD-287200.1 | asascugcAfgCfUfGfagugccgaaaaL96 | 2996 | usUfsucgg(Cgn)acucagCfuGfcaguususc | 317 |
| AD-287201.1 | ascsugcaGfcUfGfAfgugccgaaaaL96 | 2997 | usUfsuucg(Ggn)cacucaGfcUfgcagususu | 318 |
| AD-287202.1 | usgscagcUfgAfGfUfgccgaaaacuL96 | 2998 | asGfsuuuu(Cgn)ggcacuCfaGfcugcasgsu | 319 |
| AD-287203.1 | gscsagcuGfaGfUfGfccgaaaacuaL96 | 2999 | usAfsguuu(Tgn)cggcacUfcAfgcugcsasg | 320 |
| AD-287205.1 | asgsugccGfaAfAfAfCfcuaggcgucaL96 | 3000 | usGfsacgc(Cgn)uaguuuUfcGfgcacuscsa | 321 |
| AD-287206.1 | usgsccgaAfaAfCfUfaggcgucacuL96 | 3001 | asGfsugac(Ggn)ccuaguUfuUfcggcascsu | 322 |
| AD-287227.1 | csusguggGfaUfAfUfuaauaagcguL96 | 3002 | asCfsgcuu(Agn)uuaauaUfcCfcacagsasa | 323 |
| AD-287246.1 | csusgcagCfuUfAfGfugccgaaaauL96 | 24 | asUfsuuuc(Cgn)gcacucAfgCfugcagsusu | 324 |
| AD-287247.1 | csasgcugAfgUfGfCfcgaaaacuauL96 | 25 | asUfsagu(Tgn)ucggcaCfuCfagcugscsa | 325 |
| AD-287248.1 | asgscugaGfuGfCfCfgaaaacuaguL96 | 26 | asCfsuagu(Tgn)uucggcAfcUfcagcusgsc | 326 |
| AD-287249.1 | gscsugagUfgCfCfGfaaaacuagguL96 | 27 | asCfscuag(Tgn)uuucggCfaCfucagcsusg | 327 |
| AD-287250.1 | csusgaguGfcCfGfAfaaacuaggcuL96 | 28 | asGfsccua(Ggn)uuuucgGfcAfcucagscsu | 328 |
| AD-287251.1 | gsasgugcCfgAfAfAfAfcuaggcguuL96 | 29 | asAfscgcc(Tgn)aguuuuCfgGfcacucsasg | 329 |
| AD-287252.1 | gsusgccgAfaAfAfCfuaggcgucauL96 | 30 | asUfsacg(Cgn)cuaguuUfuCfggcacsusc | 330 |
| AD-287253.1 | gscscgaaAfaCfUfAfggcgucacuuL96 | 31 | asAfsguga(Cgn)gccuagUfuUfucggcsasc | 331 |
| AD-287254.1 | cscsgaaaAfcUfAfGfgcgucacuguL96 | 32 | asCfsagug(Agn)cgccuaGfuUfuucggscsa | 332 |
| AD-287258.1 | ascsuaggCfgUfCfAfcugcgcauguL96 | 33 | asCfsaugc(Ggn)cagugaCfgCfcuagususu | 333 |
| AD-287287.1 | gsasucuaUfcGfCfUfcucuaaaucaL96 | 34 | usGfsauuu(Agn)gagagcGfaUfagaucsusc | 334 |
| AD-287288.1 | csusaucgCfuCfCfUfcfuaaaucagguL96 | 35 | asCfscuga(Tgn)uuagagAfgCfgauagsasu | 335 |
| AD-287289.1 | asuscgcuCfuCfUfAfaaucaggugaL96 | 36 | usCfsaccu(Ggn)auuuagAfgAfgcgausasg | 336 |
| AD-287290.1 | uscsgcucUfcUfAfAfaucaggugaaL96 | 37 | usUfscacc(Tgn)gauuuaGfaGfagcgasusa | 337 |
| AD-287293.1 | uscsucuaAfaUfCfAfgguggaagaaL96 | 38 | usUfsucuu(Cgn)accugaUfuUfagagasgsc | 338 |
| AD-287316.1 | gsusgggGfaUfAfAfAfugcugggacaL96 | 39 | usGfsuccc(Agn)gcauuaUfuCfaccacgsgsa | 339 |
| AD-287320.1 | gsasauaaUfgCfUfGfggacaguauaL96 | 40 | usAfsuacu(Ggn)uccagCfaUfuauucsasc | 340 |
| AD-287321.1 | asasuaaUfcUfGfGfgacaguauauL96 | 41 | asUfsauac(Tgn)gucccaGfcAfuuauuscsa | 341 |
| AD-287324.1 | gsgsgacaGfuAfUfAfuccagccguL96 | 42 | asUfscggc(Tgn)ggauauAfcUfgucccsasg | 342 |
| AD-287325.1 | gsascaguAfuAfUfCfcagccgaucuL96 | 43 | asGfsaucg(Ggn)cuggauAfuAfcugucscsc | 343 |
| AD-287326.1 | ascsaguaUfaUfCfCfagccgaucuuL96 | 44 | asAfsgauc(Ggn)gcuggaUfaUfacugusscs | 344 |
| AD-287327.1 | asgsuauaUfcCfUfCfagccgaucucuL96 | 45 | asGfsaaga(Tgn)ggcugGfaUfauacusgsc | 345 |
| AD-287344.1 | asuscuauCfgCfUfCfucucuaaaucaL96 | 46 | asUfsgauu(Tgn)agagaCfgAfuagauscsu | 346 |
| AD-287346.1 | usasucgcUfcUfCfUfaaaucagguL96 | 47 | asUfsccug(Agn)uuuagaGfaGfcgausgsa | 347 |
| AD-287347.1 | csgsucucUfuCfAfAfAfucaggugauL96 | 48 | asUfsucac(Cgn)ugauuuAfgAfgagcgsasu | 348 |
| AD-287366.1 | csgsugguGfaAfUfAfaugcugggcacL96 | 49 | asUfsccca(Ggn)cauuaUfcAfccacgsasu | 349 |
| AD-287367.1 | usgsgugaAfuAfAfAfUfgcugggcacuL96 | 50 | asUfsgucc(Cgn)agcauuAfuUfcaccascsg | 350 |
| AD-287370.1 | asusgcugGfgAfCfAfguauccauL96 | 51 | asUfsggau(Agn)uacugUfcCfcagcsusa | 351 |
| AD-287371.1 | usgscuggGfaCfAfGfuauauccaguL96 | 52 | asCfsugga(Tgn)auacugUfcCfcagcasusu | 352 |
| AD-287372.1 | gscsuggGfaAfCfAfGfuauauccaguL96 | 53 | asGfscugg(Agn)uauacuGfuCfccagcsusu | 353 |
| AD-287373.1 | csusggggGfaCfaGfUfAfuauccagccuL96 | 54 | asGfsgcug(Ggn)auauacUfgGfucccagsscsa | 354 |
| AD-287374.1 | gsgsacagUfaUfAfUfccagccgauuL96 | 55 | asAfsucg(Cgn)uggauaUfaCfugucscsa | 355 |
| AD-287375.1 | csasguauAfuCfCfAfgccgaucuuL96 | 56 | asAfsagau(Cgn)ggcuggAfuAfuacugsusc | 356 |
| AD-287391.1 | cscsaaggAfuAfAfGfagaauuaccaL96 | 57 | usGfsguaa(Tgn)cucuucAfuCfcuugsgsu | 357 |
| AD-287392.1 | csasagggaUfgAfAfGfgagauuaccaaL96 | 58 | usUfsggua(Agn)ucucuuCfaAfuccuugssgsu | 358 |
| AD-287406.1 | ususgagGfuCfAfAfcauccuaggaL96 | 59 | usCfscuag(Ggn)auguugAfcCfucaaasusg | 359 |
| AD-287407.1 | usgsagguCfaAfCfAfuccuaggacuL96 | 60 | usGfsuccu(Agn)ggauguUfgAfccucasssa | 360 |
| AD-287408.1 | gsaggtucAfaCfAfUfCcfuaggacuL96 | 61 | asUfsgucc(Tgn)aggaugUfuUfgaccucsasa | 361 |
| AD-287410.1 | gsgsucaaCfaUfCfCfuaggacauuL96 | 62 | asAfsaugu(Cgn)cuaggaUfgUfugaccsusc | 362 |
| AD-287411.1 | gsuscaacAfuCfCfUfaggacauuL96 | 63 | asAfsaaug(Tgn)ccuaggAfuUfuugacsscsu | 363 |
| AD-287413.1 | ascsauccUfaGfGfAfcauuuuggaL96 | 64 | usCfscaaa(Agn)auguccUfaGfgaugusug | 364 |
| AD-287414.1 | csasuccuAfgGfAfCfauuuuggauL96 | 65 | asUfsccaa(Agn)aaugucCfuAfggaugsusu | 365 |
| AD-287415.1 | uscscuagGfaCfAfUfuuuuggaucaL96 | 66 | usGfsaucc(Agn)aaaaugUfcCfuaggasagsa | 366 |
| AD-287418.1 | asgsgacaUfuUfUfUfggaucacaaaL96 | 67 | usUfsugug(Agn)uccaaaAfaUfguccusasg | 367 |
| AD-287419.1 | gsgsacauUfTuUfTUfGfgaucacaaaaL96 | 68 | usUfsuugu(Ggn)auccaaAfaAfuguccssusa | 368 |
| AD-287421.1 | ususuuugGfaUfCfAfcaaagcacuL96 | 69 | asGfsugcu(Tgn)uugugaUfcCfaaaaasusg | 369 |
| AD-287424.1 | usgsgaucAfcAfAfAfagcacuucuuL96 | 70 | asAfsgaag(Tgn)gcuuGfuAfauccasasa | 370 |
| AD-287427.1 | csasaaagCfaCfUfUfcfuucauuegsuL96 | 71 | usCfsgaug(Ggn)aagaagUfgCfuuuugssusg | 371 |
| AD-287428.1 | asasaagcAfcUfUfCfuucauucgauL96 | 72 | asUfscgau(Ggn)gaagaaGfuGfcuuuugssu | 372 |
| AD-287429.1 | asasgcacUfuCfUfUfccaucgaugaL96 | 73 | usCfsaucg(Agn)uggaagAfaGfugcuusus | 373 |
| AD-287430.1 | asgscacuUfcUfUfCfcaucgaugaaL96 | 74 | asUfscauc(Ggn)auggaaGfaAfgugcusus | 374 |
| AD-287441.1 | gsgsagagAfaAfUfCfauggccacauL96 | 75 | asUfsgugg(Cgn)caugauUfuCfucucscsasu | 375 |
| AD-287453.1 | ascscaagGfaUfGfAfagagauuacuL96 | 76 | asGfsuaau(Cgn)ucuucaUfcCfuugussgsc | 376 |
| AD-287462.1 | asgsacauUfuGfAfGfgucaacaucuL96 | 77 | asGfsaugu(Tgn)gaccucAfaAfugucussg | 377 |
| AD-287463.1 | csasuuugAfgGfUfCfaacaucuuuL96 | 78 | asUfsagga(Ggn)uugacCfuCfaaausgsu | 378 |
| AD-287464.1 | asusuugaGfgUfCfAfacauccuaguL96 | 79 | asCfsuagg(Agn)uguugaCfcUfcaaausgsu | 379 |
| AD-287465.1 | ususgaggUfcAfAfCffauccuaggaL96 | 80 | asUfsccua(Ggn)gauguGffaCfcucaasasu | 380 |
| AD-287466.1 | csasacauCfcUfAfGfgacauuuuguL96 | 81 | csAfsaaaa(Tgn)guccuaGfgAfuguugsasc | 381 |
| AD-287467.1 | asascaucCfuAfGfGfacauuuuguL96 | 82 | asCfsaaaa(Agn)uguccaAfgGfaugususga | 382 |
| AD-287468.1 | asusccuaGfgAfCfAfuuuuuggauuL96 | 83 | asAfsucca(Agn)aaauguCfcUfaggausgsu | 383 |

TABLE 7-continued

HSD17B13 ELF7 GNA7 Modified Sequence*

| | | | | | |
|---|---|---|---|---|---|
| AD-287469.1 | cscsuaggAfcAfUfUfuuuggaucauL96 | 84 | asUfsgauc(Cgn)aaaaauGfuCfcuaggsasu | 384 |
| AD-287470.1 | gsascauuUfuUfGfgfaucacaaaauL96 | 85 | asUfsuuug(Tgn)gauccaAfaAfaugucscsu | 385 |
| AD-287474.1 | gsgsaucaCfaAfAfAfgcacuucuuuL96 | 86 | asAfsagaa(Ggn)ugcuuuUfgUfgauccsasa | 386 |
| AD-287476.1 | csascaaaAfgCfAfCfuucuuccauuL96 | 87 | asAfsugga(Agn)gaagugCfuUfuugugsasu | 387 |
| AD-287477.1 | ascsaaaaAfcAfCfUfucuuccaucuL96 | 88 | asGfsaugg(Agn)agaaguGfcUfuuugusgsa | 388 |
| AD-287478.1 | asasagcaCfuUfCfUfuccaucgauuL96 | 89 | asAfsucga(Tgn)ggaagaAfgUfgcuuususg | 389 |
| AD-287479.1 | gscsacuuCfuUfCfCfaucgaugauuL96 | 90 | asAfsucau(Cgn)gauggaAfgAfagugcsusu | 390 |
| AD-287491.1 | asgsaaauCfaUfGfGfccacaucguuL96 | 91 | asAfscgau(Ggn)uggccaUfgAfuuucuscsu | 391 |
| AD-287492.1 | asasaucaUfgGfCfCfcacaucgucauL96 | 92 | asUfsgacg(Agn)uguggcCfaUfgauuuscsu | 392 |
| AD-287517.1 | ususccuuAfcCfUfCfauccauauuL96 | 93 | asAfsuaug(Ggn)gaugagGfuUfaggaasusc | 393 |
| AD-287520.1 | ascscucaUfcCfCfAfuaauuguuccaL96 | 94 | usGfsgaac(Agn)auauggGfaUfgaggusasa | 394 |
| AD-287521.1 | uscsauccCfaUfAfUfuguccagcaL96 | 95 | usGfscugg(Agn)acaauaUfgGfgaugasgsg | 395 |
| AD-287522.1 | csasuccAfuAfUfUfguuccagcaaL96 | 96 | usUfsgcug(Ggn)aacaauAfuGfggaugsasg | 396 |
| AD-287524.1 | uscsccauAfuUfGfUfuccagcaaauL96 | 97 | asUfsuugc(Tgn)ggaacaAfuAfugggasusg | 397 |
| AD-287525.1 | cscscauaUfuUfGfUfuccagcaaauL96 | 98 | asAfsuuug(Ggn)gaacAfaUfauggggsasu | 398 |
| AD-287537.1 | usgsuuggCfuUfUfCfcacagaggucuL96 | 99 | asGfsaccu(Cgn)ugugaaAfgCfcaacasgsc | 399 |
| AD-287539.1 | gsgscuuuCfaCfAfGfaggucugacaL96 | 100 | usGfsucag(Agn)ccucugUfgAfaagccsasa | 400 |
| AD-287540.1 | gscsuuucAfcCfAfGfAfggucugacaL96 | 101 | asUfsguca(Ggn)accucuGfuGfaaagcscsa | 401 |
| AD-287543.1 | csascagaGfgUfCfUfgacaucagaaL96 | 102 | usUfscuga(Tgn)gucagaCfcUfcugugsasa | 402 |
| AD-287546.1 | asgsgucuGfaCfAfUfcagaacuucaL96 | 103 | usGfsaagu(Tgn)cuaugUfcAfgaccuscsu | 403 |
| AD-287568.1 | uscscuuaCfcUfCfAfuccccauauuL96 | 104 | asAfsauau(Ggn)ggaugaGfuGfaaggasasu | 404 |
| AD-287591.1 | ususcacaGfaGfGfUfcugacaucauL96 | 105 | asUfsgaug(Tgn)cagaccUfcUfgugaasasg | 405 |
| AD-287610.1 | ususgggaAfaAfAfCfugguaucaaaL96 | 106 | usUfsugau(Cgn)ccaguuUfuUfcccaasgsg | 406 |
| AD-287615.1 | ascsugguAfuCfAfAfaaccucauguL96 | 107 | asCfsauga(Ggn)guuugAfuAfccagususu | 407 |
| AD-287616.1 | usgsguauCfaAfAfAfccuccaugucuL96 | 108 | asGfsacau(Ggn)agguuuUfgAfuaccasgsu | 408 |
| AD-287627.1 | csuscugcCfcAfGfUfuuuugugaauL96 | 109 | asUfsucac(Agn)aaaacuGfgGfcagagsasc | 409 |
| AD-287632.1 | ususuuugUfgAfAfUfacugggucaL96 | 110 | ucGfsaacc(Cgn)aguauuCfaCfaaaascsu | 410 |
| AD-287633.1 | ususugugaAfuAfCfUfgggucaccaL96 | 111 | usGfsguga(Agn)cccaguAfuUfcacaasasa | 411 |
| AD-287634.1 | usgsugaaUfaCfUfGfgguucaccaaL96 | 112 | usUfsggug(Agn)acccagUfaUfucacasasa | 412 |
| AD-287636.1 | usgsaauaCfuGfGfGfuuccacaaaaL96 | 113 | usUfsuugg(Tgn)gaacccAfgUfauucascsa | 413 |
| AD-287637.1 | gsasauacUfgGfGfUfucaccaaaaL96 | 114 | usUfsuuug(Ggn)ugaaccCfaGfuauucsasu | 414 |
| AD-287638.1 | asasuacuGfgGfUfUfcaccaaaauL96 | 115 | asUfsuuug(Tgn)gugaaCfcCfAfguauucsca | 415 |
| AD-287647.1 | asasaaauCfcAfAfGfcacaagauuaL96 | 116 | usAfsaucu(Tgn)gugcuuGfgAfuuuusgsg | 416 |
| AD-287648.1 | asasaaucCfaAfGfCfacaagauuauL96 | 117 | asUfsaauc(Tgn)ugugcuUfgGfauuuusug | 417 |
| AD-287651.1 | asgscacaAfgAfUfUfauggccuguaL96 | 118 | usAfscagg(Cgn)cauaauCfuUfgugcususg | 418 |
| AD-287652.1 | gscsacaaGfaUfAfUfaauggccuguauL96 | 119 | asUfsacag(Ggn)ccauaaUfcUfugugcssasu | 419 |
| AD-287653.1 | csascaagAfuUfAfUfggccuguauuL96 | 120 | asAfsuaca(Ggn)gccauaAfuCfuugugscsu | 420 |
| AD-287654.1 | asasgauuAfuAfGfGfcfuguauuggaL96 | 121 | usCfscaau(Agn)caggccAfuAfaucuusgsu | 421 |
| AD-287655.1 | gsasuuauGfgGfCfCfuguauuggagaL96 | 122 | usCfsucca(Agn)uacaggCfcAfuaaucsusu | 422 |
| AD-287656.1 | ususauggCfcUfGfUfauuggagacaL96 | 123 | usGfsucuc(Cgn)aauacaGfgCfcauaasusc | 423 |
| AD-287658.1 | usgsgccuGfuAfUfUfggagacagauL96 | 124 | asUfscugu(Cgn)uccaauAfcAfggccasusa | 424 |
| AD-287659.1 | gscscuguAfuUfGfGfagacagaugaL96 | 125 | usCfsaucu(Ggn)ucuccaAfuAfcaggcscsa | 425 |
| AD-287679.1 | csusgguaUfcAfAfAfaccucaguuL96 | 126 | asAfscaug(Agn)gguuuuGfaUfaccagsusu | 426 |
| AD-287680.1 | gsgsuaucAfaAfAfCfcucauguuuL96 | 127 | asAfsgaca(Tgn)gagguUfuGfauaccsasg | 427 |
| AD-287683.1 | uscsaaaaCfcUfCfAfuguccucugcuL96 | 128 | asGfscaga(Ggn)acaugaGffuUfuuugasusa | 428 |
| AD-287690.1 | cscscaguUfuUfUfGfugaaauacuguL96 | 129 | asCfsagua(Tgn)ucacaaAfaAfcugggscsa | 429 |
| AD-287693.1 | ususuuguGfaAfUfAfcugggucauL96 | 130 | asUfsgaac(Cgn)caguauUfcAfcaaaasasc | 430 |
| AD-287694.1 | ususugugAfaAfUfCfugggucacuL96 | 131 | asGfsugaa(Tgn)ccaguaUffuCfacaaasasa | 431 |
| AD-287695.1 | asusacugGfgUfUfCfaccaaaaauL96 | 132 | asAfsuuu(Tgn)ggugaaCfcCfaguauususc | 432 |
| AD-287696.1 | usascuggGfuUfCfAfccaaaaaucuL96 | 133 | asGfsauuu(Tgn)uggugaAfcCfcaguasusu | 433 |
| AD-287700.1 | csasccaaAfaAfUfCfcaagcacaauL96 | 134 | asUfsugug(Cgn)uuggauUTuUfuggugsasa | 434 |
| AD-287701.1 | asasuccAfaGfCfAfcaagauauuL96 | 135 | asUfsuaau(Cgn)uugugcUfuGfgauuususi | 435 |
| AD-287702.1 | asasuccaAfgCfAfCffaaagauuaugcuL96 | 136 | asCfsauaa(Tgn)cuugugCfuUfggauuususu | 436 |
| AD-287703.1 | asusccaaGfcAfCfAfagauuaugguL96 | 137 | asCfscaua(Agn)ucuugugCfcUfuggausus | 437 |
| AD-287704.1 | uscscaagCfaCfAfAfgauuauggcuL96 | 138 | asGfsccau(Agn)aucuugUfgCfuuggasusu | 438 |
| AD-287706.1 | ascsaagaUfuAfUfGfgccuguauuuL96 | 139 | asAfsauac(Agn)ggccauAfaUfcuugusgsc | 439 |
| AD-287707.1 | csasagauUfaUfGfGfccuguauuuL96 | 140 | asCfsaaua(Cgn)aggccaUfaAfucuugsusu | 440 |
| AD-287709.1 | asusuaugGfcCfUfGfuauuggagaL96 | 141 | asUfscucc(Agn)auacagGfcCfauaauscsu | 441 |
| AD-287711.1 | gsgsccuuGfaUfUfGfgagacagauL96 | 142 | asAfsucug(Tgn)cuccaaUfaCfaggccsasu | 442 |
| AD-287724.1 | gsusaagaAfgUfCfUfgauaguggaL96 | 143 | usCfscauc(Tgn)aucagaCfuFfucuuacsgsa | 443 |
| AD-287725.1 | usasaagaaGfuCfUfUfauagauggaaL96 | 144 | usUfsccau(Cgn)uaucagAfcUfucuuascsg | 444 |
| AD-287726.1 | asasgaagUfcUfGfAfuagauggauL96 | 145 | asUfscca(Tgn)cuaucaGfaCfuucusasc | 445 |
| AD-287727.1 | asgsgaaguCfuGfAfUfagauggaauL96 | 146 | usAfsuucc(Agn)ucuaucAfgAfcuucusa | 446 |
| AD-287728.1 | asasgucuGfaUfAfAfAfgauggaauL96 | 147 | asGfsuauu(Cgn)caucuAfcUfagacuscsu | 447 |
| AD-287735.1 | asasauggAfaAfUfAffffuuaccaauaaL96 | 148 | asGfsauug(Ggn)uaaguaUfuCfcauusaaa | 448 |
| AD-287736.1 | asusggaaUfaCfUfUfaccaauagaL96 | 149 | usCfsfuau(Tgn)gguaagUfaUfuccauscsu | 449 |
| AD-287737.1 | usgsgaauAfcCfUfUfAccauaagaaL96 | 150 | usUfscuua(Tgn)ugguaaGfuAfuuccasusc | 450 |
| AD-287738.1 | gsgsaauaCfuUfAfCfcaauaagaaL96 | 151 | usUfsucuu(Agn)uugguaAfgUfauuccsasu | 451 |
| AD-287739.1 | asasauacUfuAfCfCfaauaagaaauL96 | 152 | usUfsucu(Tgn)aauugguAfaAfuuaucscsa | 452 |
| AD-287740.1 | asasuacuUfaCfCfAfauaagaaaauL96 | 153 | asUfsuuuc(Tgn)uauugUfaAfguauscsc | 453 |
| AD-287778.1 | ususucuuCfCfcUfGfAfacgegccucaL96 | 154 | usGfsaggc(Ggn)cguucaGfaAfagacascsu | 454 |
| AD-287793.1 | gsasuuuuAfaAfAfUfCfguaugcagaaL96 | 155 | usUfscugc(Agn)uacgauUfuAfaaaucsgsc | 455 |
| AD-287795.1 | ususuuaaAfuCfUfUfaugcagaaaL96 | 156 | usAfsuuuc(Cgn)uaucgAfuUfuaaaascsc | 456 |
| AD-287798.1 | asasaucgUfaUfUfGfCfagaauauucaL96 | 157 | usGfsauaa(Tgn)ucugcAfaCfgauuasa | 457 |
| AD-287800.1 | asuscguaUfgCfAfGfaauauucaauL96 | 158 | asUfsgaa(Tgn)auucugCfAfUfacgasusu | 458 |
| AD-287801.1 | uscsguauGfcAfGfAfaauauuccauL96 | 159 | asAfsuuga(Agn)uauucuGfcAfuacgasusu | 459 |
| AD-287802.1 | csgsuuaugCfaAfAfAfuauucaauuL96 | 160 | asAfsauug(Agn)auauucUfgCfauacgsasu | 460 |
| AD-287804.1 | asusgcagAfaAfUfAfUfucaauugaaL96 | 161 | usUfscaaa(Tgn)ugaauaUfuCfugcausasc | 461 |

TABLE 7-continued

HSD17B13 ELF7 GNA7 Modified Sequence*

| | | | | |
|---|---|---|---|---|
| AD-287810.1 | gsasagucUfgAfUfAfgauggaauauL96 | 162 | asUfsauuc(Cgn)aucuauCfaGfacuucsusu | 462 |
| AD-287811.1 | uscsugauAfgAfUfGfgaauacuuauL96 | 163 | asUfsaagu(Agn)uuccauCfuAfucagascsu | 463 |
| AD-287813.1 | gsasuggaAfuAfCfUfuaccaauauL96 | 164 | asUfsauu(Ggn)guaaguAfuUfccaucsusa | 464 |
| AD-287837.1 | ascsagaaGfuUfUfCfuuccugaacuL96 | 165 | asGfsuuca(Ggn)gaagaaAfcUfucugusasg | 465 |
| AD-287839.1 | asgsaaguUfuCfUfUfccugaacgcuL96 | 166 | asGfscguu(Cgn)aggaagAfaAfcuucusgsu | 466 |
| AD-287841.1 | asasguuuCfuUfCfCfugaacgcgcuuL96 | 167 | asGfscgcg(Tgn)ucaggaAfgAfaacuuscsu | 467 |
| AD-287842.1 | gsusuucuUfcCfUfGfaacgcgcccuuL96 | 168 | asAfsggcg(Cgn)guucagGfaAfgaaacsusu | 468 |
| AD-287844.1 | uscsuuccUfgAfAfCfgcgccucaguL96 | 169 | asCfsugag(Ggn)cgcguuCfaGfgaagasasa | 469 |
| AD-287854.1 | gscsagaaUfaUfUfCfaauuugaaguL96 | 170 | asCfsuuca(Agn)auugaaUfaUfucugcsasu | 470 |
| AD-287856.1 | asasuauuCfaAfUfUfugaagcaguuL96 | 171 | asAfscugc(Tgn)ucaaauUfgAfauauscsu | 471 |
| AD-287857.1 | usasuucaAfuUfUfGfaagcaguggcuL96 | 172 | asCfscacu(Ggn)cuucaaAfuUfgaauasusu | 472 |
| AD-287893.1 | gsasuguaUfgCfAfUfgauaaugauaL96 | 173 | usAfsucau(Tgn)aucaugCfaUfacaucsusc | 473 |
| AD-287917.1 | csasaugcUfgCfAfAfagcuuuauuuL96 | 174 | asAfsauaa(Agn)gcuuugCfaGfcauugsasu | 474 |
| AD-287924.1 | asasagcuUfuAfUfUfucacauuuuuL96 | 175 | asAfsaaau(Ggn)ugaaauAfaAfgcuuusgsc | 475 |
| AD-287934.1 | asasuuugAfaGfCfAfauggguuggcuL96 | 176 | asGfsccaa(Cgn)cacugcUfuCfaaauusgsa | 476 |
| AD-287969.1 | asasugcuGfcAfAfAfgcuuuauuucL96 | 177 | gsAfsaaua(Agn)agcuuuGfcAfgcauusgsa | 477 |
| AD-287970.1 | usgscugcAfaAfGfCfuuuauuucauL96 | 178 | asUfsgaaa(Tgn)aaagcuUfuGfcagcasusu | 478 |
| AD-287982.1 | asasaaacAfuUfGfGfuuuggcacuaL96 | 179 | usAfsgugc(Cgn)aaaccaAfuGfuuuusasa | 479 |
| AD-288005.1 | asgsauuaAfuUfAfCfucugucuuccuL96 | 180 | asGfsgaag(Agn)cagguaAfuUfaaucusug | 480 |
| AD-288006.1 | asusuaauUfaCfCfUfgucuuccuguL96 | 181 | asCfsagga(Agn)gacaggUfaAfuuaauscsu | 481 |
| AD-288008.1 | usasauuaCfcUfGfUfcuuccuguuuL96 | 182 | asAfsacag(Ggn)aagacaGfgUfaauuasasu | 482 |
| AD-288010.1 | usasccugUfcUfUfCfcuguuucucaL96 | 183 | usGfsagaa(Agn)caggaaGfaCfagguasasu | 483 |
| AD-288011.1 | ascscuguCfuUfCfCfuguuucucaaL96 | 184 | usUfsgaga(Agn)acaggaAfgAfcaggusasa | 484 |
| AD-288015.1 | uscsuuccUfgUfUfUfcucaagaauaL96 | 185 | usAfsuucu(Tgn)gagaaaCfaGfgaagascsa | 485 |
| AD-288046.1 | ususuuccUfuUfCfAfugccucuuaaL96 | 186 | usUfsaaga(Ggn)gcaugaAfaGfgaaaasasc | 486 |
| AD-288049.1 | uscscuuuCfaUfGfCfcucuuaaaaaL96 | 187 | usUfsuuua(Agn)gaggcaUfgAfaaggasasa | 487 |
| AD-288050.1 | csusuucaUfgCfCfUfcuuaaaaacuL96 | 188 | asGfsuuuu(Tgn)aagaggCfaUfgaaagsgsa | 488 |
| AD-288076.1 | asasaacaUfuGfGfUfuuggcacuauL96 | 189 | asUfsagug(Cgn)caaaccAfuGfuuuusasa | 489 |
| AD-288092.1 | gsasuuaaUfaUfAfCfCfuguucuccuuL96 | 190 | asAfsggaa(Ggn)acagguAfaUfuaaucsusu | 490 |
| AD-288094.1 | ususaccuGfuCfUfUfccguuucuuL96 | 191 | asAfsgaaa(Cgn)aggaagAfcCfagguaasusu | 491 |
| AD-288095.1 | cscsugucUffuCfCfUfguuucuaauL96 | 192 | usUfsugag(Agn)aacaggAfaGfacaggsusa | 492 |
| AD-288108.1 | gssgsucugUfuUTUfaccuuucauguL96 | 193 | asCfsauga(Agn)aaggaaAfaCfagaccsusa | 493 |
| AD-288109.1 | gsuscuguUfuUTUfCfcuuucaugcuL96 | 194 | asGfscaug(Agn)aaggaaAfaAfcagacscsu | 494 |
| AD-288173.1 | ususauuAfcAfCfAfgggaagguuuL96 | 195 | asAfsaccu(Tgn)cccuguGfuAfaauaasgsu | 495 |
| AD-288174.1 | usasuuuaCfaCfAfGfggaagguuuL96 | 196 | usAfsaacc(Tgn)uccuguUfgUfaaauasasg | 496 |
| AD-288176.1 | ususacacAfgCfGfAfagguuaagaL96 | 197 | usCfsuuaa(Agn)ccuuccCfuGfuguaasasu | 497 |
| AD-288177.1 | ascscacagGfgAfAfGfuuuaagacuL96 | 198 | asGfsucuu(Agn)aaccuuCfcCfuguguasasa | 498 |
| AD-288180.1 | gsgsaagGfuUfAfAfgacuguucaL96 | 199 | usGfsaaca(Ggn)ucuuaaAfcCfuucccsusg | 499 |
| AD-288181.1 | gsgsaaggUfuUfAfAfgacuguucaaL96 | 200 | usUfsgaac(Agn)gucuuaAfaCfcuucscsu | 500 |
| AD-288183.1 | asgsguuuAfaGfAfCffuguucaguaL96 | 201 | usAfscuug(Agn)acagucUfuAfaccususc | 501 |
| AD-288184.1 | ususuaagAfcUfGfUfucaagaugcaL96 | 202 | usGfscuac(Tgn)ugaacaGfuCfuuaaascsc | 502 |
| AD-288186.1 | usasagacUfgUfUfCfaaguagcauuL96 | 203 | asAfsugcu(Agn)cuugaaCfaGfucuuasasa | 503 |
| AD-288187.1 | gsascguUfcAfAfGfuagcauuccaL96 | 204 | usGfsgaau(Ggn)cuacuuGfaAfcaguscsu | 504 |
| AD-288188.1 | ascsuguuAfcAfUfGfagcauuccaaL96 | 205 | usUfsggaa(Tgn)gcuacuUfgAfacaguscsu | 505 |
| AD-288189.1 | csusguucAfaGfUfAfgcauuccaauL96 | 206 | asUfsugga(Agn)ugcuacUfuGfaacagsusc | 506 |
| AD-288190.1 | gsusucaaGfuAfGfGfcauuccaaucuL96 | 207 | asGfsauug(Ggn)aaugcuAfcUfugaacsasg | 507 |
| AD-288192.1 | csasaguaGfcAfUfUfccaaucuguaL96 | 208 | usAfscaga(Tgn)uggaauGfcUfacuugsasa | 508 |
| AD-288193.1 | usasgcauUfcCfAfAfucuguagccaL96 | 209 | usGfsgcua(Cgn)agauugGfaAfugcusscu | 509 |
| AD-288194.1 | asgscauuCfcAfAfUfcuguagccauL96 | 210 | asUfsggcu(Agn)cagauuGfaUfaugcusasc | 510 |
| AD-288227.1 | asascuuaUfuUfAfCfacagggaaguL96 | 211 | asCfsuucc(Cgn)uguguaAfaUfaaguuscsu | 511 |
| AD-288229.1 | usascacaGfgGfAfAfggguuuaagauL96 | 212 | asUfscuua(Agn)accuucCffcUfguguasasa | 512 |
| AD-288230.1 | csascaggGfgAfAfGfuuuaagacuL96 | 213 | asAfsgucu(Tgn)aaaccuUfcCfcguguasu | 513 |
| AD-288231.1 | asgsggaaGfgUfUfUfaagacuguuuL96 | 214 | asAfsacag(Tgn)cuuaaaCfcUfucccusgsu | 514 |
| AD-288232.1 | gsasagguUfuAfAfGfacuguucaauL96 | 215 | asUfsgaa(Cgn)agucuuAfaAfccuucscsc | 515 |
| AD-288233.1 | gsgsuuaAfgAfCfUfgucaagauaL96 | 216 | asUfsacuu(Ggn)aacaguCfuUfaaaccsusu | 516 |
| AD-288235.1 | asgsacuGfuUfCfAfaguagcauuL96 | 217 | asAfsaugc(Tgn)acuugaAfcAfgucuuascs | 517 |
| AD-288236.1 | asgsacugUfuCfAfAfguagcauuuL96 | 218 | asGfsaaug(Cgn)uacuugAfaCfagucusasa | 518 |
| AD-288237.1 | usgsuucaAffgAfUfAfGfcauccaauuL96 | 219 | asAfsuugg(Agn)augcuaCfuUfgaacasgsu | 519 |
| AD-288238.1 | ususcaagUfaGfCfAfuuccaaucuL96 | 220 | asAfsgauu(Ggn)gaaugcUfaCfuugaascsa | 520 |
| AD-288290.1 | gscsagcuUfaAfUfCfucaaccugaL96 | 221 | usCfscagg(Tgn)ugagauAfaAfgcugcscsu | 521 |
| AD-288316.1 | asgscauuUfgAfAfAfgauuucccuaL96 | 222 | asAfsggga(Agn)aucuuuCfaAfaugcusgsa | 522 |
| AD-288318.1 | usgsaaagAfuUfUfCfccuagcucuL96 | 223 | asGfsaggc(Tgn)agggaaAfuCfuuucasasa | 523 |
| AD-288319.1 | gsasaagaUfuUfCfCfcuagccucuL96 | 224 | asAfsgagg(Cgn)uagggaAfaUfcuuucasasa | 524 |
| AD-288324.1 | ususcccuAfgCfCfUfcuuccuuuuL96 | 225 | asAfsaaag(Ggn)aagaggCfuAfgggaasasu | 525 |
| AD-288337.1 | asasgaacAfcAfAfAfaugagugcauL96 | 226 | asUfsgcac(Tgn)cauucuGfuUfucuugsgu | 526 |
| AD-288338.1 | gsasacacAfgGfAfUfgagugcacaL96 | 227 | asUfsgugc(Agn)cucauuCfuGfuguucsusu | 527 |
| AD-288339.1 | asascacaGfaAfUfGfgagugcacaguL96 | 228 | asCfsugug(Cgn)acucauUfcUfgugucscsu | 528 |
| AD-288340.1 | csasgaauGfaGfUfGfcacagcuaauL96 | 229 | asUfsuagc(Tgn)gugcacUfcAfuucugsusg | 529 |
| AD-288341.1 | gsasaugaGfuGfCfAfcagcuaaguL96 | 230 | asUfscuua(Cgn)ugugcAfcUfcauucsusg | 530 |
| AD-288366.1 | ususcagcAfuUfUfGfaaagauuucuL96 | 231 | asGfsaaaau(Cgn)uuucaaAfuUfcugaasusc | 531 |
| AD-288369.1 | csasuuugAfaAfGfAfuuucccuagaL96 | 232 | asCfsuagg(Ggn)aaaucuUfuCfaaaugscsu | 532 |
| AD-288370.1 | asusuugaAfaGfAfUfuucccuagcuL96 | 233 | asGfscuag(Ggn)gaaaucUfuUfcaaausgsc | 533 |
| AD-288391.1 | asasaacgGfuGfCfAfacucauuuuL96 | 234 | asGfsaaua(Agn)agugcAfcCfguuuusgsg | 534 |
| AD-288393.1 | gsgsugcAfcUfCfAfuuucuggacuL96 | 235 | asGfsucca(Ggn)aauagAfuUfgcaccsgsu | 535 |
| AD-288394.1 | gsusgcaaCfuCfUfAfuuucuggacuL96 | 236 | asAfsguc(Cgn)gaauaAfgGfuugcacscsg | 536 |
| AD-288395.1 | usgscaacUfcUfAfUfucuggacuuuL96 | 237 | asAfsaguc(Cgn)agaauAfaGfuugcascsc | 537 |
| AD-288396.1 | gscsaacuCfuAfUfUfcuggacuuaL96 | 238 | usAfsaagu(Cgn)cagaauAfgAfguugcsasc | 538 |
| AD-288397.1 | csasacucUfaUfUfCfuggacuuuaauL96 | 239 | asUfsaaag(Tgn)ccagaaUfaGfaguugscsa | 539 |

TABLE 7-continued

HSD17B13 ELF7 GNA7 Modified Sequence*

| | | | | | |
|---|---|---|---|---|---|
| AD-288398.1 | asascucuAfuUfCfUfggacuuuauuL96 | 240 | asAfsuaaa(Ggn)uccagaAfuAfgaguusgsc | 540 |
| AD-288402.1 | asusucugGfaCfUfUfuauuacuugaL96 | 241 | usCfsaagu(Agn)auaaagUfcCfagaausasg | 541 |
| AD-288427.1 | asgsuccaCfcAfAfagugggacccuL96 | 242 | asGfsgguc(Cgn)acuuuuGfgUfggacususc | 542 |
| AD-288430.1 | csasccaaAfaGfUfGfgacccucuauL96 | 243 | asUfsagag(Ggn)guccacUfuUfuggugsgsa | 543 |
| AD-288431.1 | ascscaaaAfgUfGfGfaccccucuauaL96 | 244 | usAfsuaga(Ggn)gguccaCfuUTuuggusgsg | 544 |
| AD-288432.1 | cscsaaaaGfuGfGfAfcccucuauauL96 | 245 | asUfsuaag(Agn)ggguccAfcUfuuuggsusg | 545 |
| AD-288433.1 | csasaaagUfgGfAfCfccucuauauuL96 | 246 | asAfsuaua(Ggn)agggucCfaCfuuuugsgsu | 546 |
| AD-288434.1 | asasaaguGfgAfCfCfcucuauauuuL96 | 247 | asAfsauau(Agn)gaggguCfcAfcuuusgsg | 547 |
| AD-288466.1 | asasacggUfgCfAfAfcucuauucuL96 | 248 | asAfsgaau(Agn)gaguugCfaCfcguuusgsg | 548 |
| AD-288467.1 | asascgguGfcAfAfCfucuauucuguL96 | 249 | asCfsagaa(Tgn)agaguuGfcAfccguususu | 549 |
| AD-288470.1 | usasuucuGfgAfCfCfuuauuacuuuL96 | 250 | asAfsagua(Agn)uaaaguCfcAfgaauasgsa | 550 |
| AD-288491.1 | asasagugGfaCfCfCfucuauauuucL96 | 251 | gsAfsaaua(Tgn)agagggUfcCfacuuusasg | 551 |
| AD-288492.1 | asasguggAfcCfCfUfcuauauuucL96 | 252 | asGfsaaau(Agn)uagaggGfuCfcacuususu | 552 |
| AD-288561.1 | asusguuuAfgAfCfAfauuuuaggcuL96 | 253 | asGfsccua(Agn)aauuguCfuAfaacauscsu | 553 |
| AD-288562.1 | gsusuuagAfcAfAfUfuuuaggcucaL96 | 254 | usGfsagcc(Tgn)aaaauuGfuCfuaaacsasu | 554 |
| AD-288563.1 | ususuagaCfaAfUfUfuuuaggcucaaL96 | 255 | usUfsgagc(Cgn)uaaaauUfgGfucuaaascsa | 555 |
| AD-288564.1 | ususagacAfaUfUfUfuaggcucaaaL96 | 256 | usUfsugag(Cgn)cuaaaaUfuGfucuaasasc | 556 |
| AD-288565.1 | usasgacaAfuUfUfUfaggcucaaaaL96 | 257 | usUfsuuga(Ggn)ccuaaaAfuUfgucuasasa | 557 |
| AD-288566.1 | asgsacaaUfuUTUfAfggcucaaaaaL96 | 258 | usUfsuuug(Ggn)gccuaaAfaUfugucusasa | 558 |
| AD-288567.1 | gsascaauUfuUfAfAfgcucaaaaaL96 | 259 | asUfsuuuu(Ggn)agccuaAfaAfuugucsusa | 559 |
| AD-288572.1 | ususuaggcUfcAfAfAfaauuaaagcuL96 | 260 | asGfscuuu(Agn)auuuuuGfaGfccuaasasa | 560 |
| AD-288573.1 | usasgggcuCfaAfAfAfauuaaagcuaL96 | 261 | usAfsgcuu(Tgn)aauuuuUfgGfccuasasa | 561 |
| AD-288574.1 | usgsggcucAfaAfAfAfuuaaagcuaaL96 | 262 | usUfsagcu(Tgn)uaauuuUfuGfagccusasa | 562 |
| AD-288575.1 | gscsucaaAfaAfUfUfaaagcuaacaL96 | 263 | usGfsuuag(Cgn)uuuaauUfuUfugagcscsu | 563 |
| AD-288576.1 | uscsaaaaAfuUfAfAfagcuaacacaL96 | 264 | usGfsuguu(Agn)gcuuuAfuUfuuugasgsc | 564 |
| AD-288613.1 | ususcauaUfaUfCfCfuuggucccauL96 | 265 | asUfsggga(Cgn)caaggaUfaUfaugaasasg | 565 |
| AD-288620.1 | gsasguuuUfaGfAfCfaauuuuagguL96 | 266 | asCfscuaa(Agn)auugucUfaAfacaucsusc | 566 |
| AD-288624.1 | gsgscucaAfaAfAfUfuaaagcuaauL96 | 267 | asUfsuagc(Tgn)uuaauuUfuUfgagccsusa | 567 |
| AD-288625.1 | csuscaaaAfaUfUfAfaagcuaacauL96 | 268 | asUfsgguu(Ggn)cuuuaaUfuUfuugagscsc | 568 |
| AD-288626.1 | csasaaaaUfuAfAfAfgcuaacacauL96 | 269 | asUfsgugu(Tgn)agcuuuAfaUfuuuugsasg | 569 |
| AD-288628.1 | asasauuaAfaGfCfUfaacacaggaaL96 | 270 | usUfsccug(Tgn)guuagcUfuUfaauuusuu | 570 |
| AD-288634.1 | usasacacAfgGfAfAfaaggaacuguL96 | 271 | asCfsaguu(Cgn)cuuuucCfuGfuguuasgsc | 571 |
| AD-288637.1 | gsgsaaaaGfgAfAfCfuguacuggcuL96 | 272 | asGfsccag(Tgn)acaguuCfcCfuuuccsusg | 572 |
| AD-288639.1 | asasaaggAfaCfUfGfuacuggcuauL96 | 273 | asUfsagcc(Agn)guacagUfuCfcuuuuscsc | 573 |
| AD-288642.1 | gsgsaacuGfuAfCfUfggcuauuacaL96 | 274 | usGfsuaau(Agn)gccaguAfcAfguuccsusu | 574 |
| AD-288696.1 | csasgggaaAfaGfFfAfacuguacuguL96 | 275 | asCfsagua(Cgn)aguuccUfuUfuccugsasa | 575 |
| AD-288698.1 | asgsgaacUfgUfAfCfuggcuauuaL96 | 276 | asUfsaaua(Ggn)ccaguaCfaGfuuccususu | 576 |
| AD-288912.1 | csuscccaCfuAfCfAfucaagacuaaL96 | 277 | usUfsaguc(Tgn)ugauguAfgGfgggagsusc | 577 |
| AD-288913.1 | uscsccacUfaCfAfUfcaagacuaauL96 | 278 | asUfsuagu(Cgn)uugaugUfaGfugggasgsu | 578 |
| AD-288914.1 | cscsacuaCfaUfCfAfagacuaaucuL96 | 279 | asGfsauua(Ggn)ucuugaUfgUfagugsgsa | 579 |
| AD-288915.1 | csascuacAfuCfAfAfgacuaaucuuL96 | 280 | asAfsgauu(Agn)gucuugAfuCfuagugsgsg | 580 |
| AD-288916.1 | csusacauCfaAfGfAfcuaaucuuguL96 | 281 | asCfsaaga(Tgn)uagucuUfgAfuguagsusg | 581 |
| AD-288917.1 | usascaucAfaGfAfCfuaaucuuguuL96 | 282 | asAfscaag(Agn)uuagucUfuGfauguasgsu | 582 |
| AD-288918.1 | ascsaucaAfgAfCfUfaaucuuguuuL96 | 283 | asAfsacaa(Agn)auuagcCfuUfgauguasg | 583 |
| AD-288933.1 | gsusguuuUfuCfAfCfaugauauauaL96 | 284 | usAfsuaau(Agn)caugugAfaAfaacacsasc | 584 |
| AD-288937.1 | uscsacauGfuAfUfUfauagaaugcuL96 | 285 | asGfscauu(Cgn)uauaauAfcAfugugasasa | 585 |
| AD-288938.1 | csascaugUfaUfUfAfuagaaugcuuL96 | 286 | asAfsgcau(Tgn)cuauaaUfaCfaugugsasa | 586 |
| AD-288941.1 | gsusauuaUfaGfAfAfugcuuuugcaL96 | 287 | usGfscaaa(Agn)gcauucUfaAfaaucsasu | 587 |
| AD-288943.1 | usasuagaAfuGfCfUfuuugcauggaL96 | 288 | usCfscaug(Cgn)aaaagcAfuUfcuauasasu | 588 |
| AD-288945.1 | asgsaaugCfuUfUfUfgcauggacuaL96 | 289 | usAfsgucc(Agn)ugcaaaAfgCfauucusasu | 589 |
| AD-288946.1 | gsasaugcUfuUTUfGfcauggacuauL96 | 290 | asUfsaguc(Cgn)augcaaAfaGfcauucsusa | 590 |
| AD-288947.1 | usgscuuuUfgCfAfUfggacuauccuL96 | 291 | asGfsgaua(Ggn)uccaugCfaAfaagcasusu | 591 |
| AD-288948.1 | csusuuugCfaUfGfGfacuauccucuL96 | 292 | asGfsagga(Tgn)aguccaUfgCfaaaagscsa | 592 |
| AD-288950.1 | ususgcauGfgAfCfUfauccucuugL96 | 293 | asCfsaaga(Ggn)gauagCfcAfugcaasasa | 593 |
| AD-288951.1 | usgscaugGfaCfUfAfuccucuuguuL96 | 294 | asAfscaag(Agn)ggauagUfcCfaugcasasa | 594 |
| AD-288952.1 | gscsauggAfcUfAfUfccucuuguuuL96 | 295 | asAfsacaa(Ggn)aggauaGfuCfcaugcsasa | 595 |
| AD-288956.1 | ggsacuaUfcCfUfCfuuguuuuuauL96 | 296 | asUfsaaaa(Agn)caagagGfaUfaguccsasu | 596 |
| AD-288957.1 | gsascuauCfcUfCfUfuguuuuuauuL96 | 297 | asUfsuaaa(Agn)acaagaGfgAfuaguscsa | 597 |
| AD-288959.1 | csusauccUfcUfUfGfuuuuuauuaaL96 | 298 | usUfsaaua(Agn)aaacaaGfaGfgauagsusc | 598 |
| AD-288981.1 | cscsacuAfcAfUfCfaagacuaauuL96 | 299 | asAfsuuag(Tgn)cuugauGfuAfgugggsasg | 599 |
| AD-288982.1 | ascsuacaAfcAfAfGfacuaaucuuuL96 | 300 | asAfsagau(Tgn)agucuuGfaUfguagusgsg | 600 |
| AD-288996.1 | asusgcuuUfuGfCfAfuggacuaucuL96 | 301 | asGfsauag(Tgn)ccaugcAfaAfagcaususc | 601 |

| Duplex Name | mRNA target sequence 5' to 3' | SEQ ID NO: |
|---|---|---|
| AD-286958.1 | ACAGUACCUCCUCCCUAGGACUA | 602 |
| AD-287001.1 | AAUCCUUCUGCUUCUGAUCACCA | 603 |
| AD-287012.1 | ACCAUCAUCUACUCCUACUUGGA | 604 |
| AD-287014.1 | CAUCUACUCCUACUUGGAGUCGU | 605 |
| AD-287015.1 | AUCUACUCCUACUUGGAGUCGUU | 606 |
| AD-287017.1 | CAGUACCUCCUCCCUAGGACUAC | 607 |
| AD-287026.1 | CUACACAAGGACUGAACCAGAAG | 608 |
| AD-287059.1 | UCACCAUCAUCUACUCCUACUUG | 609 |
| AD-287060.1 | CACCAUCAUCUACUCCUACUUGG | 610 |
| AD-287061.1 | CCAUCAUCUACUCCUACUUGGAG | 611 |
| AD-287062.1 | AUCAUCUACUCCUACUUGGAGUC | 612 |

TABLE 7-continued

| HSD17B13 ELF7 GNA7 Modified Sequence* | | |
|---|---|---|
| AD-287064.1 | UCUACUCCUACUUGGAGUCGUUG | 613 |
| AD-287065.1 | CUACUCCUACUUGGAGUCGUUGG | 614 |
| AD-287066.1 | UACUCCUACUUGGAGUCGUUGGU | 615 |
| AD-287126.1 | ACUCCUACUUGGAGUCGUUGGUG | 616 |
| AD-287200.1 | GAAACUGCAGCUGAGUGCCGAAA | 617 |
| AD-287201.1 | AAACUGCAGCUGAGUGCCGAAAA | 618 |
| AD-287202.1 | ACUGCAGCUGAGUGCCGAAAACU | 619 |
| AD-287203.1 | CUGCAGCUGAGUGCCGAAAACUA | 620 |
| AD-287205.1 | UGAGUGCCGAAAACUAGGCGUCA | 621 |
| AD-287206.1 | AGUGCCGAAAACUAGGCGUCACU | 622 |
| AD-287227.1 | UUCUGUGGGAUAUUAAUAAGCGC | 623 |
| AD-287246.1 | AACUGCAGCUGAGUGCCGAAAAC | 624 |
| AD-287247.1 | UGCAGCUGAGUGCCGAAAACUAG | 625 |
| AD-287248.1 | GCAGCUGAGUGCCGAAAACUAGG | 626 |
| AD-287249.1 | CAGCUGAGUGCCGAAAACUAGGC | 627 |
| AD-287250.1 | AGCUGAGUGCCGAAAACUAGGCG | 628 |
| AD-287251.1 | CUGAGUGCCGAAAACUAGGCGUC | 629 |
| AD-287252.1 | GAGUGCCGAAAACUAGGCGUCAC | 630 |
| AD-287253.1 | GUGCCGAAAACUAGGCGUCACUG | 631 |
| AD-287254.1 | UGCCGAAAACUAGGCGUCACUGC | 632 |
| AD-287258.1 | AAACUAGGCGUCACUGCGCAUGC | 633 |
| AD-287287.1 | GAGAUCUAUCGCUCUCUAAAUCA | 634 |
| AD-287288.1 | AUCUAUCGCUCUCUAAAUCAGGU | 635 |
| AD-287289.1 | CUAUCGCUCUCUAAAUCAGGUGA | 636 |
| AD-287290.1 | UAUCGCUCUCUAAAUCAGGUGAA | 637 |
| AD-287293.1 | GCUCUCUAAAUCAGGUGAAGAAA | 638 |
| AD-287316.1 | UCGUGGUGAAUAAUGCUGGGACA | 639 |
| AD-287320.1 | GUGAAUAAUGCUGGGACAGUAUA | 640 |
| AD-287321.1 | UGAAUAAUGCUGGGACAGUAUAU | 641 |
| AD-287324.1 | CUGGGACAGUAUAUCCAGCCGAU | 642 |
| AD-287325.1 | GGGACAGUAUAUCCAGCCGAUCU | 643 |
| AD-287326.1 | GGACAGUAUAUCCAGCCGAUCUU | 644 |
| AD-287327.1 | ACAGUAUAUCCAGCCGAUCUUCU | 645 |
| AD-287344.1 | AGAUCUAUCGCUCUCUAAAUCAG | 646 |
| AD-287346.1 | UCUAUCGCUCUCUAAAUCAGGUG | 647 |
| AD-287347.1 | AUCGCUCUCUAAAUCAGGUGAAG | 648 |
| AD-287366.1 | AUCGUGGUGAAUAAUGCUGGGAC | 649 |
| AD-287367.1 | CGUGGUGAAUAAUGCUGGGACAG | 650 |
| AD-287370.1 | UAAUGCUGGGACAGUAUAUCCAG | 651 |
| AD-287371.1 | AAUGCUGGGACAGUAUAUCCAGC | 652 |
| AD-287372.1 | AUGCUGGGACAGUAUAUCCAGCC | 653 |
| AD-287373.1 | UGCUGGGACAGUAUAUCCAGCCG | 654 |
| AD-287374.1 | UGGGACAGUAUAUCCAGCCGAUC | 655 |
| AD-287375.1 | GACAGUAUAUCCAGCCGAUCUUC | 656 |
| AD-287391.1 | CACCAAGGAUGAAGAGAUUACCA | 657 |
| AD-287392.1 | ACCAAGGAUGAAGAGAUUACCAA | 658 |
| AD-287406.1 | CAUUUGAGGUCAACAUCCUAGGA | 659 |
| AD-287407.1 | UUUGAGGUCAACAUCCUAGGACA | 660 |
| AD-287408.1 | UUGAGGUCAACAUCCUAGGACAU | 661 |
| AD-287410.1 | GAGGUCAACAUCCUAGGACAUUU | 662 |
| AD-287411.1 | AGGUCAACAUCCUAGGACAUUUU | 663 |
| AD-287413.1 | CAACAUCCUAGGACAUUUUUGGA | 664 |
| AD-287414.1 | AACAUCCUAGGACAUUUUUGGAU | 665 |
| AD-287415.1 | CAUCCUAGGACAUUUUUGGAUCA | 666 |
| AD-287418.1 | CUAGGACAUUUUUGGAUCACAAA | 667 |
| AD-287419.1 | UAGGACAUUUUUGGAUCACAAAA | 668 |
| AD-287421.1 | CAUUUUUGGAUCACAAAAGCACU | 669 |
| AD-287424.1 | UUUGGAUCACAAAAGCACUUCUU | 670 |
| AD-287427.1 | CACAAAAGCACUUCUUCCAUCGA | 671 |
| AD-287428.1 | ACAAAAGCACUUCUUCCAUCGAU | 672 |
| AD-287429.1 | AAAAGCACUUCUUCCAUCGAUGA | 673 |
| AD-287430.1 | AAAGCACUUCUUCCAUCGAUGAU | 674 |
| AD-287441.1 | AUGGAGAGAAAUCAUGGCCACAU | 675 |
| AD-287453.1 | GCACCAAGGAUGAAGAGAUUACC | 676 |
| AD-287462.1 | CAAGACAUUUGAGGUCAACAUCC | 677 |
| AD-287463.1 | GACAUUUGAGGUCAACAUCCUAG | 678 |
| AD-287464.1 | ACAUUUGAGGUCAACAUCCUAGG | 679 |
| AD-287465.1 | AUUUGAGGUCAACAUCCUAGGAC | 680 |
| AD-287466.1 | GUCAACAUCCUAGGACAUUUUUG | 681 |
| AD-287467.1 | UCAACAUCCUAGGACAUUUUUGG | 682 |
| AD-287468.1 | ACAUCCUAGGACAUUUUUGGAUC | 683 |
| AD-287469.1 | AUCCUAGGACAUUUUUGGAUCAC | 684 |
| AD-287470.1 | AGGACAUUUUUGGAUCACAAAAG | 685 |
| AD-287474.1 | UUGGAUCACAAAAGCACUUCUUC | 686 |
| AD-287476.1 | AUCACAAAAGCACUUCUUCCAUC | 687 |
| AD-287477.1 | UCACAAAAGCACUUCUUCCAUCG | 688 |
| AD-287478.1 | CAAAAGCACUUCUUCCAUCGAUG | 689 |
| AD-287479.1 | AAGCACUUCUUCCAUCGAUGAUG | 690 |

TABLE 7-continued

HSD17B13 ELF7 GNA7 Modified Sequence*

| | | |
|---|---|---|
| AD-287491.1 | AGAGAAAUCAUGGCCACAUCGUC | 691 |
| AD-287492.1 | AGAAAUCAUGGCCACAUCGUCAC | 692 |
| AD-287517.1 | GAUUCCUUACCUCAUCCCAUAUU | 693 |
| AD-287520.1 | UUACCUCAUCCCAUAUUGUUCCA | 694 |
| AD-287521.1 | CCUCAUCCCAUAUUGUUCCAGCA | 695 |
| AD-287522.1 | CUCAUCCCAUAUUGUUCCAGCAA | 696 |
| AD-287524.1 | CAUCCCAUAUUGUUCCAGCAAAU | 697 |
| AD-287525.1 | AUCCCAUAUUGUUCCAGCAAAUU | 698 |
| AD-287537.1 | GCUGUUGGCUUUCACAGAGGUCU | 699 |
| AD-287539.1 | UUGGCUUUCACAGAGGUCUGACA | 700 |
| AD-287540.1 | UGGCUUUCACAGAGGUCUGACAU | 701 |
| AD-287543.1 | UUCACAGAGGUCUGACAUCAGAA | 702 |
| AD-287546.1 | AGAGGUCUGACAUCAGAACUUCA | 703 |
| AD-287568.1 | AUUCCUUACCUCAUCCCAUAUUG | 704 |
| AD-287591.1 | CUUUCACAGAGGUCUGACAUCAG | 705 |
| AD-287610.1 | CCUUGGGAAAAACUGGUAUCAAA | 706 |
| AD-287615.1 | AAACUGGUAUCAAAACCUCAUGU | 707 |
| AD-287616.1 | ACUGGUAUCAAAACCUCAUGUCU | 708 |
| AD-287627.1 | GUCUCUGCCCAGUUUUUGUGAAU | 709 |
| AD-287632.1 | AGUUUUUGUGAAUACUGGGUUCA | 710 |
| AD-287633.1 | UUUUGUGAAUACUGGGUUCACCA | 711 |
| AD-287634.1 | UUUGUGAAUACUGGGUUCACCAA | 712 |
| AD-287636.1 | UGUGAAUACUGGGUUCACCAAAA | 713 |
| AD-287637.1 | GUGAAUACUGGGUUCACCAAAAA | 714 |
| AD-287638.1 | UGAAUACUGGGUUCACCAAAAAU | 715 |
| AD-287647.1 | CCAAAAAUCCAAGCACAAGAUUA | 716 |
| AD-287648.1 | CAAAAAUCCAAGCACAAGAUUAU | 717 |
| AD-287651.1 | CAAGCACAAGAUUAUGGCCUGUA | 718 |
| AD-287652.1 | AAGCACAAGAUUAUGGCCUGUAU | 719 |
| AD-287653.1 | AGCACAAGAUUAUGGCCUGUAUU | 720 |
| AD-287654.1 | ACAAGAUUAUGGCCUGUAUUGGA | 721 |
| AD-287655.1 | AAGAUUAUGGCCUGUAUUGGAGA | 722 |
| AD-287656.1 | GAUUAUGGCCUGUAUUGGAGACA | 723 |
| AD-287658.1 | UAUGGCCUGUAUUGGAGACAGAU | 724 |
| AD-287659.1 | UGGCCUGUAUUGGAGACAGAUGA | 725 |
| AD-287679.1 | AACUGGUAUCAAAACCUCAUGUC | 726 |
| AD-287680.1 | CUGGUAUCAAAACCUCAUGUCUC | 727 |
| AD-287683.1 | UAUCAAAACCUCAUGUCUCUGCC | 728 |
| AD-287690.1 | UGCCCAGUUUUUGUGAAUACUGG | 729 |
| AD-287693.1 | GUUUUGUGAAUACUGGGUUCAC | 730 |
| AD-287694.1 | UUUUUGUGAAUACUGGGUUCACC | 731 |
| AD-287695.1 | GAAUACUGGGUUCACCAAAAAUC | 732 |
| AD-287696.1 | AAUACUGGGUUCACCAAAAAUCC | 733 |
| AD-287700.1 | UUCACCAAAAAUCCAAGCACAAG | 734 |
| AD-287701.1 | AAAAAUCCAAGCACAAGAUUAUG | 735 |
| AD-287702.1 | AAAAUCCAAGCACAAGAUUAUGG | 736 |
| AD-287703.1 | AAAUCCAAGCACAAGAUUAUGGC | 737 |
| AD-287704.1 | AAUCCAAGCACAAGAUUAUGGCC | 738 |
| AD-287706.1 | GCACAAGAUUAUGGCCUGUAUUG | 739 |
| AD-287707.1 | CACAAGAUUAUGGCCUGUAUUGG | 740 |
| AD-287709.1 | AGAUUAUGGCCUGUAUUGGAGAC | 741 |
| AD-287711.1 | AUGGCCUGUAUUGGAGACAGAUG | 742 |
| AD-287724.1 | UCGUAAGAAGUCUGAUAGAUGGA | 743 |
| AD-287725.1 | CGUAAGAAGUCUGAUAGAUGGAA | 744 |
| AD-287726.1 | GUAAGAAGUCUGAUAGAUGGAAU | 745 |
| AD-287727.1 | UAAGAAGUCUGAUAGAUGGAAUA | 746 |
| AD-287728.1 | AGAAGUCUGAUAGAUGGAAUACU | 747 |
| AD-287735.1 | AUAGAUGGAAUACUUACCAAUAA | 748 |
| AD-287736.1 | AGAUGGAAUACUUACCAAUAAGA | 749 |
| AD-287737.1 | GAUGGAAUACUUACCAAUAAGAA | 750 |
| AD-287738.1 | AUGGAAUACUUACCAAUAAGAAA | 751 |
| AD-287739.1 | UGGAAUACUUACCAAUAAGAAAA | 752 |
| AD-287740.1 | GGAAUACUUACCAAUAAGAAAAU | 753 |
| AD-287778.1 | AGUUUCUUCCUGAACGCGCCUCA | 754 |
| AD-287793.1 | GCGAUUUAAAUCGUAUGCAGAA | 755 |
| AD-287795.1 | GAUUUUAAAUCGUAUGCAGAAUA | 756 |
| AD-287798.1 | UUAAAUCGUAUGCAGAAUAUUCA | 757 |
| AD-287800.1 | AAAUCGUAUGCAGAAUAUUCAAU | 758 |
| AD-287801.1 | AAUCGUAUGCAGAAUAUUCAAUU | 759 |
| AD-287802.1 | AUCGUAUGCAGAAUAUUCAAUUU | 760 |
| AD-287804.1 | GUAUGCAGAAUAUUCAAUUUGAA | 761 |
| AD-287810.1 | AAGAAGUCUGAUAGAUGGAAUAC | 762 |
| AD-287811.1 | AGUCUGAUAGAUGGAAUACUUAC | 763 |
| AD-287813.1 | UAGAUGGAAUACUUACCAAUAAG | 764 |
| AD-287837.1 | CUACAGAAGUUUCUUCCUGAACG | 765 |
| AD-287839.1 | ACAGAAGUUUCUUCCUGAACGCG | 766 |
| AD-287841.1 | AGAAGUUUCUUCCUGAACGCGCC | 767 |
| AD-287842.1 | AAGUUUCUUCCUGAACGCGCCUC | 768 |

TABLE 7-continued

HSD17B13 ELF7 GNA7 Modified Sequence*

| | | |
|---|---|---|
| AD-287844.1 | UUUCUUCCUGAACGCGCCUCAGC | 769 |
| AD-287854.1 | AUGCAGAAUAUUCAAUUUGAAGC | 770 |
| AD-287856.1 | AGAAUAUUCAAUUUGAAGCAGUG | 771 |
| AD-287857.1 | AAUAUUCAAUUUGAAGCAGUGGU | 772 |
| AD-287893.1 | GAGAUGUAUGCAUGAUAAUGAUA | 773 |
| AD-287917.1 | AUCAAUGCUGCAAAGCUUUAUUU | 774 |
| AD-287924.1 | GCAAAGCUUUAUUCACAUUUUU | 775 |
| AD-287934.1 | UCAAUUUGAAGCAGUGGUUGGCC | 776 |
| AD-287969.1 | UCAAUGCUGCAAAGCUUUAUUC | 777 |
| AD-287970.1 | AAUGCUGCAAAGCUUUAUUUCAC | 778 |
| AD-287982.1 | UUAAAAACAUUGGUUUGGCACUA | 779 |
| AD-288005.1 | CAAGAUUAAUUACCUGUCUUCCU | 780 |
| AD-288006.1 | AGAUUAAUUACCUGUCUUCCUGU | 781 |
| AD-288008.1 | AUUAAUUACCUGUCUUCCUGUUU | 782 |
| AD-288010.1 | AUUACCUGUCUUCCUGUUUCUCA | 783 |
| AD-288011.1 | UUACCUGUCUUCCUGUUUCUCAA | 784 |
| AD-288015.1 | UGUCUUCCUGUUUCUCAAGAAUA | 785 |
| AD-288046.1 | GUUUUUCCUUUCAUGCCUCUUAA | 786 |
| AD-288049.1 | UUUCCUUUCAUGCCUCUUAAAAA | 787 |
| AD-288050.1 | UCCUUUCAUGCCUCUUAAAAACU | 788 |
| AD-288076.1 | UAAAAACAUUGGUUUGGCACUAG | 789 |
| AD-288092.1 | AAGAUUAAUUACCUGUCUUCCUG | 790 |
| AD-288094.1 | AAUUACCUGUCUUCCUGUUUCUC | 791 |
| AD-288095.1 | UACCUGUCUUCCUGUUUCUCAAG | 792 |
| AD-288108.1 | UAGGUCUGUUUUUCCUUUCAUGC | 793 |
| AD-288109.1 | AGGUCUGUUUUUCCUUUCAUGCC | 794 |
| AD-288173.1 | ACUUAUUUACACAGGGAAGGUUU | 795 |
| AD-288174.1 | CUUAUUUACACAGGGAAGGUUUA | 796 |
| AD-288176.1 | AUUUACACAGGGAAGGUUUAAGA | 797 |
| AD-288177.1 | UUACACAGGGAAGGUUUAAGACU | 798 |
| AD-288180.1 | CAGGGAAGGUUUAAGACUGUUCA | 799 |
| AD-288181.1 | AGGGAAGGUUUAAGACUGUUCAA | 800 |
| AD-288183.1 | GAAGGUUUAAGACUGUUCAAGUA | 801 |
| AD-288184.1 | GGUUUAAGACUGUUCAAGUAGCA | 802 |
| AD-288186.1 | UUUAAGACUGUUCAAGUAGCAUU | 803 |
| AD-288187.1 | AAGACUGUUCAAGUAGCAUUCCA | 804 |
| AD-288188.1 | AGACUGUUCAAGUAGCAUUCCAA | 805 |
| AD-288189.1 | GACUGUUCAAGUAGCAUUCCAAU | 806 |
| AD-288190.1 | CUGUUCAAGUAGCAUUCCAAUCU | 807 |
| AD-288192.1 | UUCAAGUAGCAUUCCAAUCUGUA | 808 |
| AD-288193.1 | AGUAGCAUUCCAAUCUGUAGCCA | 809 |
| AD-288194.1 | GUAGCAUUCCAAUCUGUAGCCAU | 810 |
| AD-288227.1 | AGAACUUAUUUACACAGGGAAGG | 811 |
| AD-288229.1 | UUUACACAGGGAAGGUUUAAGAC | 812 |
| AD-288230.1 | UACACAGGGAAGGUUUAAGACUG | 813 |
| AD-288231.1 | ACAGGGAAGGUUUAAGACUGUUC | 814 |
| AD-288232.1 | GGGAAGGUUUAAGACUGUUCAAG | 815 |
| AD-288233.1 | AAGGUUUAAGACUGUUCAAGUAG | 816 |
| AD-288235.1 | UUAAGACUGUUCAAGUAGCAUUC | 817 |
| AD-288236.1 | UAAGACUGUUCAAGUAGCAUUCC | 818 |
| AD-288237.1 | ACUGUUCAAGUAGCAUUCCAAUC | 819 |
| AD-288238.1 | UGUUCAAGUAGCAUUCCAAUCUG | 820 |
| AD-288290.1 | AGGCAGCUUUAUCUCAACCUGGA | 821 |
| AD-288316.1 | UCAGCAUUUGAAAGAUUUCCCUA | 822 |
| AD-288318.1 | UUUGAAAGAUUUCCCUAGCCUCU | 823 |
| AD-288319.1 | UUGAAAGAUUUCCCUAGCCUCUU | 824 |
| AD-288324.1 | AUUUCCCUAGCCUCUUCCUUUUU | 825 |
| AD-288337.1 | ACAAGAACACAGAAUGAGUGCAC | 826 |
| AD-288338.1 | AAGAACACAGAAUGAGUGCACAG | 827 |
| AD-288339.1 | AGAACACAGAAUGAGUGCACAGC | 828 |
| AD-288340.1 | CACAGAAUGAGUGCACAGCUAAG | 829 |
| AD-288341.1 | CAGAAUGAGUGCACAGCUAAGAG | 830 |
| AD-288366.1 | GAUUCAGCAUUUGAAAGAUUUCC | 831 |
| AD-288369.1 | AGCAUUUGAAAGAUUUCCCUAGC | 832 |
| AD-288370.1 | GCAUUUGAAAGAUUUCCCUAGCC | 833 |
| AD-288391.1 | CCAAAACGGUGCAACUCUAUUCU | 834 |
| AD-288393.1 | ACGGUGCAACUCUAUUCUGGACU | 835 |
| AD-288394.1 | CGGUGCAACUCUAUUCUGGACUU | 836 |
| AD-288395.1 | GGUGCAACUCUAUUCUGGACUUU | 837 |
| AD-288396.1 | GUGCAACUCUAUUCUGGACUUUA | 838 |
| AD-288397.1 | UGCAACUCUAUUCUGGACUUUAU | 839 |
| AD-288398.1 | GCAACUCUAUUCUGGACUUUAUU | 840 |
| AD-288402.1 | CUAUUCUGGACUUUAUUACUUGA | 841 |
| AD-288427.1 | GAAGUCCACCAAAAGUGGACCCU | 842 |
| AD-288430.1 | UCCACCAAAAGUGGACCCUCUAU | 843 |
| AD-288431.1 | CCACCAAAAGUGGACCCUCUAUA | 844 |
| AD-288432.1 | CACCAAAAGUGGACCCUCUAUAU | 845 |
| AD-288433.1 | ACCAAAAGUGGACCCUCUAUAUU | 846 |

TABLE 7-continued

HSD17B13 ELF7 GNA7 Modified Sequence*

| | | |
|---|---|---|
| AD-288434.1 | CCAAAAGUGGACCCUCUAUAUUU | 847 |
| AD-288466.1 | CAAAACGGUGCAACUCUAUUCUG | 848 |
| AD-288467.1 | AAAACGGUGCAACUCUAUUCUGG | 849 |
| AD-288470.1 | UCUAUUCUGGACUUUAUUACUUG | 850 |
| AD-288491.1 | CAAAAGUGGACCCUCUAUAUUUC | 851 |
| AD-288492.1 | AAAAGUGGACCCUCUAUAUUUCC | 852 |
| AD-288561.1 | AGAUGUUUAGACAAUUUUAGGCU | 853 |
| AD-288562.1 | AUGUUUAGACAAUUUUAGGCUCA | 854 |
| AD-288563.1 | UGUUUAGACAAUUUUAGGCUCAA | 855 |
| AD-288564.1 | GUUUAGACAAUUUUAGGCUCAAA | 856 |
| AD-288565.1 | UUUAGACAAUUUUAGGCUCAAAA | 857 |
| AD-288566.1 | UUAGACAAUUUUAGGCUCAAAAA | 858 |
| AD-288567.1 | UAGACAAUUUUAGGCUCAAAAAU | 859 |
| AD-288572.1 | UUUUAGGCUCAAAAAUUAAAGCU | 860 |
| AD-288573.1 | UUUAGGCUCAAAAAUUAAAGCUA | 861 |
| AD-288574.1 | UUAGGCUCAAAAAUUAAAGCUAA | 862 |
| AD-288575.1 | AGGCUCAAAAAUUAAAGCUAACA | 863 |
| AD-288576.1 | GCUCAAAAAUUAAAGCUAACACA | 864 |
| AD-288613.1 | CUUUCAUAUAUCCUUGGUCCCAG | 865 |
| AD-288620.1 | GAGAUGUUUAGACAAUUUUAGGC | 866 |
| AD-288624.1 | UAGGCUCAAAAAUUAAAGCUAAC | 867 |
| AD-288625.1 | GGCUCAAAAAUUAAAGCUAACAC | 868 |
| AD-288626.1 | CUCAAAAAUUAAAGCUAACACAG | 869 |
| AD-288628.1 | AAAAAUUAAAGCUAACACAGGAA | 870 |
| AD-288634.1 | GCUAACACAGGAAAAGGAACUGU | 871 |
| AD-288637.1 | CAGGAAAAGGAACUGUACUGGCU | 872 |
| AD-288639.1 | GGAAAAGGAACUGUACUGGCUAU | 873 |
| AD-288642.1 | AAGGAACUGUACUGGCUAUUACA | 874 |
| AD-288696.1 | CACAGGAAAAGGAACUGUACUGG | 875 |
| AD-288698.1 | AAAGGAACUGUACUGGCUAUUAC | 876 |
| AD-288912.1 | GACUCCCACUACAUCAAGACUAA | 877 |
| AD-288913.1 | ACUCCCACUACAUCAAGACUAAU | 878 |
| AD-288914.1 | UCCCACUACAUCAAGACUAAUCU | 879 |
| AD-288915.1 | CCCACUACAUCAAGACUAAUCUU | 880 |
| AD-288916.1 | CACUACAUCAAGACUAAUCUUGU | 881 |
| AD-288917.1 | ACUACAUCAAGACUAAUCUUGUU | 882 |
| AD-288918.1 | CUACAUCAAGACUAAUCUUGUUU | 883 |
| AD-288933.1 | GUGUGUUUUCACAUGUAUUAUA | 884 |
| AD-288937.1 | UUUCACAUGUAUUAUAGAAUGCU | 885 |
| AD-288938.1 | UUCACAUGUAUUAUAGAAUGCUU | 886 |
| AD-288941.1 | AUGUAUUAUAGAAUGCUUUUGCA | 887 |
| AD-288943.1 | AUUAUAGAAUGCUUUUGCAUGGA | 888 |
| AD-288945.1 | AUAGAAUGCUUUUGCAUGGACUA | 889 |
| AD-288946.1 | UAGAAUGCUUUUGCAUGGACUAU | 890 |
| AD-288947.1 | AAUGCUUUUGCAUGGACUAUCCU | 891 |
| AD-288948.1 | UGCUUUUGCAUGGACUAUCCUCU | 892 |
| AD-288950.1 | UUUUGCAUGGACUAUCCUCUUGU | 893 |
| AD-288951.1 | UUUGCAUGGACUAUCCUCUUGUU | 894 |
| AD-288952.1 | UUGCAUGGACUAUCCUCUUGUUU | 895 |
| AD-288956.1 | AUGGACUAUCCUCUUGUUUUUAU | 896 |
| AD-288957.1 | UGGACUAUCCUCUUGUUUUUAUU | 897 |
| AD-288959.1 | GACUAUCCUCUUGUUUUUAUUAA | 898 |
| AD-288981.1 | CUCCCACUACAUCAAGACUAAUC | 899 |
| AD-288982.1 | CCACUACAUCAAGACUAAUCUUG | 900 |
| AD-288996.1 | GAAUGCUUUUGCAUGGACUAUCC | 901 |

*Target: HSD17B13

TABLE 8

HSD17B13 ELF7 GNA7 Unmodified Sequence*

| Duplex Name | Sense sequence 5' to 3' | SEQ ID NO: | Position in NM_178135.4 | Antisense sequence 5' to 3' | SEQ ID NO: | Position in NM_178135.4 |
|---|---|---|---|---|---|---|
| AD-286958.1 | AGUACCUCCUCCCUAGGACUA | 902 | 5-25 | UAGUCCUAGGGAGGAGGUACUGU | 1202 | 3-25 |
| AD-287001.1 | UCCUUCUGCUUCUGAUCACCA | 903 | 85-105 | UGGUGAUCAGAAGCAGAAGGAUU | 1203 | 83-105 |
| AD-287012.1 | CAUCAUCUACUCCUACUUGGA | 904 | 104-124 | UCCAAGUAGGAGUAGAUGAUGGU | 1204 | 102-124 |
| AD-287015.1 | CUACUCCUACUUGGAGUCGUU | 906 | 110-130 | AACGACUCCAAGUAGGAGUAGAU | 1206 | 108-130 |
| AD-287017.1 | GUACCUCCUCCCUAGGACUAU | 907 | 6-26 | AUAGUCCUAGGGAGGAGGUACU | 1207 | 4-26 |
| AD-287026.1 | ACACAAGGACUGAACCAGAAU | 908 | 25-45 | AUUCUGGUUCAGUCCUUGUGUAG | 1208 | 23-45 |
| AD-287059.1 | ACCAUCAUCUACUCCUACUUU | 909 | 102-122 | AAAGUAGGAGUAGAUGAUGGUGA | 1209 | 100-122 |
| AD-287060.1 | CCAUCAUCUACUCCUACUUGU | 910 | 103-123 | ACAAGUAGGAGUAGAUGAUGGUG | 1210 | 101-123 |
| AD-287061.1 | AUCAUCUACUCCUACUUGGAU | 911 | 105-125 | AUCCAAGUAGGAGUAGAUGAUGG | 1211 | 103-125 |
| AD-287062.1 | CAUCUACUCCUACUUGGAGUU | 912 | 107-127 | AACUCCAAGUAGGAGUAGAUGAU | 1212 | 105-127 |

TABLE 8-continued

HSD17B13 ELF7 GNA7 Unmodified Sequence*

| Duplex Name | Sense sequence 5' to 3' | SEQ ID NO: | Position in NM_178135.4 | Antisense sequence 5' to 3' | SEQ ID NO: | Position in NM_178135.4 |
|---|---|---|---|---|---|---|
| AD-287064.1 | UACUCCUACUUGGAGUCGUUU | 913 | 111-131 | AAACGACUCCAAGUAGGAGUAGA | 1213 | 109-131 |
| AD-287065.1 | ACUCCUACUUGGAGUCGUUGU | 914 | 112-132 | ACAACGACUCCAAGUAGGAGUAG | 1214 | 110-132 |
| AD-287126.1 | UCCUACUUGGAGUCGUUGGUU | 916 | 114-134 | AACCAACGACUCCAAGUAGGAGU | 1216 | 112-134 |
| AD-287203.1 | GCAGCUGAGUGCCGAAAACUA | 920 | 294-314 | UAGUUUCGGCACUCAGCUGCAG | 1220 | 292-314 |
| AD-287227.1 | CUGUGGGAUAUUAAUAAGCGU | 923 | 258-278 | ACGCUUAUUAAUAUCCCACAGAA | 1223 | 256-278 |
| AD-287246.1 | CUGCAGCUGAGUGCCGAAAAU | 924 | 292-312 | AUUUUCGGCACUCAGCUGCAGUU | 1224 | 290-312 |
| AD-287247.1 | CAGCUGAGUGCCGAAAACUAU | 925 | 295-315 | AUAGUUUCGGCACUCAGCUGCA | 1225 | 293-315 |
| AD-287248.1 | AGCUGAGUGCCGAAAACUAGU | 926 | 296-316 | ACUAGUUUCGGCACUCAGCUGC | 1226 | 294-316 |
| AD-287249.1 | GCUGAGUGCCGAAAACUAGGU | 927 | 297-317 | ACCUAGUUUCGGCACUCAGCUG | 1227 | 295-317 |
| AD-287250.1 | CUGAGUGCCGAAAACUAGGCU | 928 | 298-318 | AGCCUAGUUUCGGCACUCAGCU | 1228 | 296-318 |
| AD-287251.1 | GAGUGCCGAAAACUAGGCGUU | 929 | 300-320 | AACGCCUAGUUUUCGGCACUCAG | 1229 | 298-320 |
| AD-287252.1 | GUGCCGAAAACUAGGCGUCAU | 930 | 302-322 | AUGACGCCUAGUUUUCGGCACUC | 1230 | 300-322 |
| AD-287253.1 | GCCGAAAACUAGGCGUCACUU | 931 | 304-324 | AAGUGACGCCUAGUUUUCGGCAC | 1231 | 302-324 |
| AD-287254.1 | CCGAAAACUAGGCGUCACUGU | 932 | 305-325 | ACAGUGACGCCUAGUUUUCGGCA | 1232 | 303-325 |
| AD-287258.1 | ACUAGGCGUCACUGCCAUGU | 933 | 311-331 | ACAUGCGCAGUGACGCCUAGUUU | 1233 | 309-331 |
| AD-287288.1 | CUAUCGCUCUCUAAAUCAGGU | 935 | 365-385 | ACCUGAUUUAGAGAGCGAUAGAU | 1235 | 363-385 |
| AD-287290.1 | UCGCUCUCUAAAUCAGGUGAA | 937 | 368-388 | UUCACCUGAUUUAGAGAGCGAUA | 1237 | 366-388 |
| AD-287293.1 | UCUCUAAAUCAGGUGAAGAAA | 938 | 372-392 | UUUCUUCACCUGAUUUAGAGAGC | 1238 | 370-392 |
| AD-287316.1 | GUGGUGAAUAAUGCUGGGACA | 939 | 414-434 | UGUCCCAGCAUUAUUCACCACGA | 1239 | 412-434 |
| AD-287320.1 | GAAUAAUGCUGGGACAGUAUA | 940 | 419-439 | UAUACUGUCCCAGCAUUAUUCAC | 1240 | 417-439 |
| AD-287321.1 | AAUAAUGCUGGGACAGUAUAU | 941 | 420-440 | AUAUACTGUCCCAGCAUUAUUCA | 1241 | 418-440 |
| AD-287324.1 | GGGACAGUAUAUCCAGCCGAU | 942 | 429-449 | AUCGGCUGGAUAUACUGUCCCAG | 1242 | 427-449 |
| AD-287325.1 | GACAGUAUAUCCAGCCGAUCU | 943 | 431-451 | AGAUCGGCUGGAUAUACUGUCCC | 1243 | 429-451 |
| AD-287326.1 | ACAGUAUAUCCAGCCGAUCUU | 944 | 432-452 | AAGAUCGGCUGGAUAUACUGUCC | 1244 | 430-452 |
| AD-287327.1 | AGUAUAUCCAGCCGAUCUUCU | 945 | 434-454 | AGAAGAUCGGCUGGAUAUACUGU | 1245 | 432-454 |
| AD-287344.1 | AUCUAUCGCUCUCUAAAUCAU | 946 | 363-383 | AUGAUUUAGAGAGCGAUAGAUCU | 1246 | 361-383 |
| AD-287346.1 | UAUCGCUCUCUAAAUCAGGU | 947 | 366-386 | AACCUGAUUUAGAGAGCGAUAGA | 1247 | 364-386 |
| AD-287347.1 | CGCUCUCUAAAUCAGGUGAAU | 948 | 369-389 | AUUCACCUGAUUUAGAGAGCGAU | 1248 | 367-389 |
| AD-287366.1 | CGUGGUGAAUAAUGCUGGGAU | 949 | 413-433 | AUCCCAGCAUUAUUCACCACGAU | 1249 | 411-433 |
| AD-287367.1 | UGGUGAAUAAUGCUGGGACAU | 950 | 415-435 | AUGUCCCAGCAUUAUUCACCACG | 1250 | 413-435 |
| AD-287370.1 | AUGCUGGGACAGUAUAUCCAU | 951 | 424-444 | AUGGAUAUACUGUCCCAGCAUUA | 1251 | 422-444 |
| AD-287371.1 | UGCUGGGACAGUAUAUCCAGU | 952 | 425-445 | ACUGGATAUACUGUCCCAGCAUU | 1252 | 423-445 |
| AD-287372.1 | GCUGGGACAGUAUAUCCAGCU | 953 | 426-446 | AGCUGGAUAUACUGUCCCAGCAU | 1253 | 424-446 |
| AD-287373.1 | CUGGGACAGUAUAUCCAGCCU | 954 | 427-447 | AGGCUGGAUAUACUGUCCCAGCA | 1254 | 425-447 |
| AD-287374.1 | GGACAGUAUAUCCAGCCGAUU | 955 | 430-450 | AAUCGGCUGGAUAUACUGUCCCA | 1255 | 428-450 |
| AD-287375.1 | CAGUAUAUCCAGCCGAUCUUU | 956 | 433-453 | AAAGAUCGGCUGGAUAUACUGUC | 1256 | 431-453 |
| AD-287391.1 | CCAAGGAUGAAGAGAUUACCA | 957 | 460-480 | UGGUAAUCUCUUCAUCCUUGGUG | 1257 | 458-480 |
| AD-287406.1 | UUUGAGGUCAACAUCCUAGGA | 959 | 486-506 | UCCUAGGAUGUUGACCUCAAAUG | 1259 | 484-506 |
| AD-287407.1 | UGAGGUCAACAUCCUAGGACA | 960 | 488-508 | UGUCCUAGGAUGUUGACCUCAAA | 1260 | 486-508 |
| AD-287408.1 | GAGGUCAACAUCCUAGGACAU | 961 | 489-509 | AUGUCCTAGGAUGUUGACCUCAA | 1261 | 487-509 |
| AD-287411.1 | GUCAACAUCCUAGGACAUUUU | 963 | 492-512 | AAAAUGTCCUAGGAUGUUGACCU | 1263 | 490-512 |
| AD-287413.1 | ACAUCCUAGGACAUUUUUGGA | 964 | 496-516 | UCCAAAAAUGUCCUAGGAUGUUG | 1264 | 494-516 |
| AD-287414.1 | CAUCCUAGGACAUUUUUGGAU | 965 | 497-517 | AUCCAAAAAUGUCCUAGGAUGUU | 1265 | 495-517 |
| AD-287418.1 | AGGACAUUUUUGGAUCACAAA | 967 | 503-523 | UUUGUGAUCCAAAAAUGUCCUA | 1267 | 501-523 |
| AD-287419.1 | GGACAUUUUUGGAUCACAAAA | 968 | 504-524 | UUUUGUGAUCCAAAAAUGUCCUA | 1268 | 502-524 |
| AD-287421.1 | UUUUUGGAUCACAAAAGCACU | 969 | 509-529 | AGUGCUUUGUGAUCCAAAAAUG | 1269 | 507-529 |
| AD-287424.1 | UGGAUCACAAAAGCACUUCUU | 970 | 513-533 | AAGAAGTGCUUUUGUGAUCCAAA | 1270 | 511-533 |
| AD-287427.1 | CAAAAGCACUUCUUCCAUCGA | 971 | 520-540 | UCGAUGGAAGAAGUGCUUUUGUG | 1271 | 518-540 |
| AD-287428.1 | AAAAGCACUUCUUCCAUCGAU | 972 | 521-541 | AUCGAUGGAAGAAGUGCUUUUGU | 1272 | 519-541 |
| AD-287453.1 | ACCAAGGAUGAAGAGAUUACU | 976 | 459-479 | AGUAAUCUCUUCAUCCUUGGUGC | 1276 | 457-479 |
| AD-287462.1 | AGACAUUUGAGGUCAACAUCU | 977 | 481-501 | AGAUGTGACCUCAAAUGUCUUG | 1277 | 479-501 |
| AD-287463.1 | CAUUUGAGGUCAACAUCCUAU | 978 | 484-504 | AUAGGATGUUGACCUCAAAUGUC | 1278 | 482-504 |
| AD-287464.1 | AUUUGAGGUCAACAUCCUAGU | 979 | 485-505 | ACUAGGAUGUUGACCUCAAAUGU | 1279 | 483-505 |
| AD-287465.1 | UUGAGGUCAACAUCCUAGGAU | 980 | 487-507 | AUCCUAGGAUGUUGACCUCAAAU | 1280 | 485-507 |
| AD-287466.1 | CAACAUCCUAGGACAUUUUUG | 981 | 494-514 | CAAAAATGUCCUAGGAUGUUGAC | 1281 | 492-514 |
| AD-287467.1 | AACAUCCUAGGACAUUUUUGU | 982 | 495-515 | ACAAAATGUCCUAGGAUGUUGA | 1282 | 493-515 |
| AD-287468.1 | AUCCUAGGACAUUUUUGGAUU | 983 | 498-518 | AAUCCAAAAAUGUCCUAGGAUGU | 1283 | 496-518 |
| AD-287469.1 | CCUAGGACAUUUUUGGAUCAU | 984 | 500-520 | AUGAUCCAAAAAUGUCCUAGGAU | 1284 | 498-520 |
| AD-287470.1 | GACAUUUUUGGAUCACAAAAU | 985 | 505-525 | AUUUUGTGAUCCAAAAAUGUCCU | 1285 | 503-525 |
| AD-287474.1 | GGAUCACAAAAGCACUUCUUU | 986 | 514-534 | AAAGAAGUGCUUUUGUGAUCCAA | 1286 | 512-534 |
| AD-287476.1 | CACAAAAGCACUUCUUCCAUU | 987 | 518-538 | AAUGGAAGAAGUGCUUUUGUGAU | 1287 | 516-538 |
| AD-287477.1 | ACAAAAGCACUUCUUCCAUCU | 988 | 519-539 | AGAUGGAAGAAGUGCUUUUGUGA | 1288 | 517-539 |
| AD-287478.1 | AAAGCACUUCUUCCAUCGAUU | 989 | 522-542 | AAUCGATGGAAGAAGUGCUUUUG | 1289 | 520-542 |
| AD-287479.1 | GCACUUCUUCCAUCGAUGAUU | 990 | 525-545 | AAUCAUCGAUGGAAGAAGUGCUU | 1290 | 523-545 |
| AD-287491.1 | AGAAACAUGGCCACAUCGUCU | 991 | 549-569 | AACGAUGUGGCCAUGAUUUCUCU | 1291 | 547-569 |
| AD-287492.1 | AAAUCAUGGCCACAUCGUCAU | 992 | 551-571 | AUGACGAUGUGGCCAUGAUUUCU | 1292 | 549-571 |
| AD-287517.1 | UUCCUUACCUCAUCCCAUAUU | 993 | 601-621 | AAUAUGGGAUGAGGUAAGGAAUC | 1293 | 599-621 |
| AD-287520.1 | ACCUCAUCCCAUAUUGUUCCA | 994 | 607-627 | UGGAACAAUAUGGGAUGAGGUAA | 1294 | 605-627 |
| AD-287521.1 | UCAUCCCAUAUUGUUCCAGCA | 995 | 610-630 | UGCUGGAACAAUAUGGGAUGAG | 1295 | 608-630 |
| AD-287524.1 | UCCCAUAUUGUUCCAGCAAAU | 997 | 613-633 | AUUUGCTGAACAAUAUGGGAUG | 1297 | 611-633 |
| AD-287525.1 | CCCAUAUUGUUCCAGCAAAUU | 998 | 614-634 | AAUUUGCUGGAACAAUAUGGGAU | 1298 | 612-634 |
| AD-287537.1 | UGUUGGCUUUCACAGAGGUCU | 999 | 641-661 | AGACCUCUGUGAAAGCCAACAGC | 1299 | 639-661 |
| AD-287539.1 | GGCUUUCACAGAGGUCUGACA | 1000 | 645-665 | UGUCAGACCUCUGUGAAAGCCAA | 1300 | 643-665 |
| AD-287543.1 | CACAGAGGUCUGACAUCAGAA | 1002 | 651-671 | UUCUGATGUCAGACCUCUGUGAA | 1302 | 649-671 |

TABLE 8-continued

HSD17B13 ELF7 GNA7 Unmodified Sequence*

| Duplex Name | Sense sequence 5' to 3' | SEQ ID NO: | Position in NM_178135.4 | Antisense sequence 5' to 3' | SEQ ID NO: | Position in NM_178135.4 |
|---|---|---|---|---|---|---|
| AD-287546.1 | AGGUCUGACAUCAGAACUUCA | 1003 | 656-676 | UGAAGUUCUGAUGUCAGACCUCU | 1303 | 654-676 |
| AD-287568.1 | UCCUUACCUCAUCCCAUAUUU | 1004 | 602-622 | AAAUAUGGGAUGAGGUAAGGAU | 1304 | 600-622 |
| AD-287591.1 | UUCACAGAGGUCUGACAUCAU | 1005 | 649-669 | AUGAUGUCAGACCUCUGUGAAAG | 1305 | 647-669 |
| AD-287610.1 | UUGGGAAAAACUGGUAUCAAA | 1006 | 681-701 | UUUGAUACCAGUUUUUCCCAAGG | 1306 | 679-701 |
| AD-287616.1 | UGGUAUCAAAACCUCAUGUCU | 1008 | 692-712 | AGACAUGAGGUUUUGAUACCAGU | 1308 | 690-712 |
| AD-287627.1 | CUCUGCCCAGUUUUUGUGAAU | 1009 | 711-731 | AUUCACAAAAACUGGGCAGAGAC | 1309 | 709-731 |
| AD-287632.1 | UUUUUGUGAAUACUGGGUUCA | 1010 | 721-741 | UGAACCCAGUAUUCACAAAAACU | 1310 | 719-741 |
| AD-287636.1 | UGAAUACUGGGUUCACCAAAA | 1013 | 727-747 | UUUUGGTGAACCCAGUAUUCACA | 1313 | 725-747 |
| AD-287637.1 | GAAUACUGGGUUCACCAAAAA | 1014 | 728-748 | UUUUUGGUGAACCCAGUAUUCAC | 1314 | 726-748 |
| AD-287647.1 | AAAAAUCCAAGCACAAGAUUA | 1016 | 744-764 | UAAUCUGUGCUUGGAUUUUUGG | 1316 | 742-764 |
| AD-287648.1 | AAAAUCCAAGCACAAGAUUAU | 1017 | 745-765 | AUAAUCUGUGCUUGGAUUUUUG | 1317 | 743-765 |
| AD-287654.1 | AAGAUUAUGGCCUGUAUUGGA | 1021 | 758-778 | UCCAAUACAGGCCAUAAUCUUGU | 1321 | 756-778 |
| AD-287655.1 | GAUUAUGGCCUGUAUUGGAGA | 1022 | 760-780 | UCUCCAAUACAGGCCAUAAUCU | 1322 | 758-780 |
| AD-287659.1 | GCCUGUAUUGGAGACAGAUGA | 1025 | 767-787 | UCAUCUGUCUCCAAUACAGGCCA | 1325 | 765-787 |
| AD-287679.1 | CUGGUAUCAAAACCUCAUGUU | 1026 | 691-711 | AACAUGAGGUUUUGAUACCAGUU | 1326 | 689-711 |
| AD-287680.1 | GGUAUCAAAACCUCAUGUCUU | 1027 | 693-713 | AAGACATGAGGUUUUGAUACCAG | 1327 | 691-713 |
| AD-287683.1 | UCAAAACCUCAUGUCUCUGCU | 1028 | 697-717 | AGCAGAGACAUGAGGUUUUGAUA | 1328 | 695-717 |
| AD-287690.1 | CCCAGUUUUUGUGAAUACUGU | 1029 | 716-736 | ACAGUAUUCACAAAAACUGGGCA | 1329 | 714-736 |
| AD-287693.1 | UUUUGUGAAUACUGGGUUCAU | 1030 | 722-742 | AUGAACCCAGUAUUCACAAAAAC | 1330 | 720-742 |
| AD-287694.1 | UUUGUGAAUACUGGGUUCACU | 1031 | 723-743 | AGUGAACCCAGUAUUCACAAAAA | 1331 | 721-743 |
| AD-287695.1 | AUACUGGGUUCACCAAAAAUU | 1032 | 730-750 | AAUUUUGGUGAACCCAGUAUUC | 1332 | 728-750 |
| AD-287696.1 | UACUGGGUUCACCAAAAAUCU | 1033 | 731-751 | AGAUUUUGGUGAACCCAGUAUU | 1333 | 729-751 |
| AD-287700.1 | CACCAAAAAUCCAAGCACAAU | 1034 | 740-760 | AUUGUGCUUGGAUUUUUGGUGAA | 1334 | 738-760 |
| AD-287701.1 | AAAUCCAAGCACAAGAUUAUU | 1035 | 746-766 | AAUAAUCUUGUGCUUGGAUUUUU | 1335 | 744-766 |
| AD-287702.1 | AAUCCAAGCACAAGAUUAUGU | 1036 | 747-767 | ACAUAAUCUUGUGCUUGGAUUUU | 1336 | 745-767 |
| AD-287703.1 | AUCCAAGCACAAGAUUAUGGU | 1037 | 748-768 | ACCAUAAUCUUGUGCUUGGAUUU | 1337 | 746-768 |
| AD-287704.1 | UCCAAGCACAAGAUUAUGGCU | 1038 | 749-769 | AGCCAUAAUCUUGUGCUUGGAUU | 1338 | 747-769 |
| AD-287706.1 | ACAAGAUUAUGGCCUGUAUUU | 1039 | 756-776 | AAAUACAGGCCAUAAUCUUGUGC | 1339 | 754-776 |
| AD-287707.1 | CAAGAUUAUGGCCUGUAUUGU | 1040 | 757-777 | ACAAUACAGGCCAUAAUCUUGUG | 1340 | 755-777 |
| AD-287709.1 | AUUAUGGCCUGUAUUGGAGAU | 1041 | 761-781 | AUCUCCAAUACAGGCCAUAAUCU | 1341 | 759-781 |
| AD-287711.1 | GGCCUGUAUUGGAGACAGAUU | 1042 | 766-786 | AAUCUGTCCCAAUACAGGCCAU | 1342 | 764-786 |
| AD-287724.1 | GUAAGAAGUCUGAUAGAUGGA | 1043 | 792-812 | UCCAUCUAUCAGACUUCUUACGA | 1343 | 790-812 |
| AD-287726.1 | AAGAAGUCUGAUAGAUGGAAU | 1045 | 794-814 | AUUCCAUCUAUCAGACUUCUUAC | 1345 | 792-814 |
| AD-287727.1 | AGAAGUCUGAUAGAUGGAAUA | 1046 | 795-815 | UAUUCCAUCUAUCAGACUUCUUA | 1346 | 793-815 |
| AD-287735.1 | AGAUGGAAUACUUACCAAUAA | 1048 | 806-826 | UUAUUGGUAAGUAUUCCAUCUAU | 1348 | 804-826 |
| AD-287736.1 | AUGGAACUUACCAAUAAGA | 1049 | 808-828 | UCUUAUUGGUAAGUAUUCCAUCU | 1349 | 806-828 |
| AD-287737.1 | UGGAAUACUUACCAAUAAGAA | 1050 | 809-829 | UUCUUAUGGUAAGUAUUCCAUC | 1350 | 807-829 |
| AD-287738.1 | GGAAUACUUACCAAUAAGAAA | 1051 | 810-830 | UUUCUUAUUGGUAAGUAUUCCAU | 1351 | 808-830 |
| AD-287739.1 | GAAUACUUACCAAUAAGAAAA | 1052 | 811-831 | UUUUCUAUUGGUAAGUAUUCCA | 1352 | 809-831 |
| AD-287740.1 | AAUACUUACCAAUAAGAAAAU | 1053 | 812-832 | AUUUUCUUAUUGGUAAGUAUUCC | 1353 | 810-832 |
| AD-287778.1 | UUUCUUCCUGAACGCGCCUCA | 1054 | 879-899 | UGAGGCGCGUUCAGGAAGAAACU | 1354 | 877-899 |
| AD-287798.1 | AAAUCGUAUGCAGAAUAUUCA | 1057 | 908-928 | UGAAUAUUCUGCAUACGAUUUAA | 1357 | 906-928 |
| AD-287800.1 | AUCGUAUGCAGAAUAUUCAAU | 1058 | 910-930 | AUUGAAUAUUCUGCAUACGAUUU | 1358 | 908-930 |
| AD-287801.1 | UCGUAUGCAGAAUAUUCAAUU | 1059 | 911-931 | AAUUGAAUAUUCUGCAUACGAUU | 1359 | 909-931 |
| AD-287802.1 | CGUAUGCAGAAUAUUCAAUUU | 1060 | 912-932 | AAAUUGAAUAUUCUGCAUACGAU | 1360 | 910-932 |
| AD-287804.1 | AUGCAGAAUAUUCAAUUGAA | 1061 | 915-935 | UUCAAAUUGAAUAUUCUGCAUAC | 1361 | 913-935 |
| AD-287810.1 | GAAGUCUGAUAGAUGGAAUAU | 1062 | 796-816 | AUAUUCCAUCUAUCAGACUUCUU | 1362 | 794-816 |
| AD-287811.1 | UCUGAUAGAUGGAAUACUUAU | 1063 | 800-820 | AUAAGUAUUCCAUCUAUCAGACU | 1363 | 798-820 |
| AD-287813.1 | GAUGGAAUACUUACCAAUAAU | 1064 | 807-827 | AUUAUUGGUAAGUAUUCCAUCUA | 1364 | 805-827 |
| AD-287837.1 | ACAGAAGUUUCUUCCUGAACU | 1065 | 872-892 | AGUUCAGGAAGAAACUUCUGUAG | 1365 | 870-892 |
| AD-287839.1 | AGAAGUUUCUUCCUGAACGCU | 1066 | 874-894 | AGCGUUCAGGAAGAAACUUCUGU | 1366 | 872-894 |
| AD-287841.1 | AAGUUUCUUCCUGAACGCGCU | 1067 | 876-896 | AGCGCGUUCAGGAAGAAACUUCU | 1367 | 874-896 |
| AD-287842.1 | GUUUCUUCCUGAACGCGCCUU | 1068 | 878-898 | AAGGCGCGUUCAGGAAGAAACUU | 1368 | 876-898 |
| AD-287844.1 | UCUUCCUGAACGCGCCUCAGU | 1069 | 881-901 | ACUGAGGCGCGUUCAGGAAGAAA | 1369 | 879-901 |
| AD-287854.1 | GCAGAAUAUUCAAUUGAAGU | 1070 | 917-937 | ACUUCAAAUUGAAUAUUCUGCAU | 1370 | 915-937 |
| AD-287856.1 | AAUAUUCAAUUGAAGCAGUU | 1071 | 921-941 | AACUGCUUCAAAUUGAAUAUUCU | 1371 | 919-941 |
| AD-287893.1 | GAUGUAUGCAUGAUAAUGAUA | 1073 | 989-1009 | UAUCAUUAUCAUGCAUACAUCUC | 1373 | 987-1009 |
| AD-287917.1 | CAAUGCUGCAAAGCUUUAUUU | 1074 | 1025-1045 | AAAUAAAGCUUUGCAGCAUUGAU | 1374 | 1023-1045 |
| AD-287924.1 | AAAGCUUUAUUUCACAUUUUU | 1075 | 1034-1054 | AAAAAUGUGAAAUAAAGCUUUGC | 1375 | 1032-1054 |
| AD-287934.1 | AAUUGAAGCAGUGGUUGGCU | 1076 | 928-948 | AGCCAACCACUGCUUCAAAUUGA | 1376 | 926-948 |
| AD-287969.1 | AAUGCUGCAAAGCUUUAUUUC | 1077 | 1026-1046 | GAAAUAAAGCUUUGCAGCAUUGA | 1377 | 1024-1046 |
| AD-287970.1 | UGCUGCAAAGCUUUAUUUCAU | 1078 | 1028-1048 | AUGAAAUAAAGCUUUGCAGCAUU | 1378 | 1026-1048 |
| AD-288005.1 | AGAUUAAUUACCUGUCUUCCU | 1080 | 1111-1131 | AGGAAGACAGGUAAUUAAUCUUG | 1380 | 1109-1131 |
| AD-288006.1 | AUUAAUUACCUGUCUUCCUGU | 1081 | 1113-1133 | ACAGGAAGACAGGUAAUUAAUCU | 1381 | 1111-1133 |
| AD-288008.1 | UAAUUACCUGUCUUCCUGUUU | 1082 | 1115-1135 | AAACAGGAAGACAGGUAAUUAAU | 1382 | 1113-1135 |
| AD-288010.1 | UACCUGUCUUCCUGUUUCUCA | 1083 | 1119-1139 | UGAGAAACAGGAAGACAGGUAAU | 1383 | 1117-1139 |
| AD-288011.1 | ACCUGUCUUCCUGUUUCUCAA | 1084 | 1120-1140 | UUGAGAAACAGGAAGACAGGUAA | 1384 | 1118-1140 |
| AD-288015.1 | UCUUCCUGUUUCUCAAGAAUA | 1085 | 1125-1145 | UAUUCUGAGAAACAGGAAGACA | 1385 | 1123-1145 |
| AD-288046.1 | UUUUCCUUCAUGCCUCUUAAA | 1086 | 1171-1191 | UUAAGAGGCAUGAAGGAAAA | 1386 | 1169-1191 |
| AD-288049.1 | UCCUUUCAUGCCUCUUAAAAA | 1087 | 1174-1194 | UUUUUAAGAGGCAUGAAGGAAA | 1387 | 1172-1194 |
| AD-288050.1 | CUUUCAUGCCUCUUAAAAACU | 1088 | 1176-1196 | AGUUUUAAGAGGCAUGAAGGA | 1388 | 1174-1196 |
| AD-288076.1 | AAAACAUUGGUUUGGCACUAU | 1089 | 1073-1093 | AUAGUGCCAAACCAAUGUUUUUA | 1389 | 1071-1093 |
| AD-288092.1 | GAUUAAUUACCUGUCUUCCUU | 1090 | 1112-1132 | AAGGAAGACAGGUAAUUAAUCUU | 1390 | 1110-1132 |
| AD-288094.1 | UUACCUGUCUUCCUGUUUCUU | 1091 | 1118-1138 | AAGAAACAGGAAGACAGGUAAUU | 1391 | 1116-1138 |

TABLE 8-continued

HSD17B13 ELF7 GNA7 Unmodified Sequence*

| Duplex Name | Sense sequence 5' to 3' | SEQ ID NO: | Position in NM_178135.4 | Antisense sequence 5' to 3' | SEQ ID NO: | Position in NM_178135.4 |
|---|---|---|---|---|---|---|
| AD-288095.1 | CCUGUCUUCCUGUUUCUCAAU | 1092 | 1121-1141 | AUUGAGAAACAGGAAGACAGGUA | 1392 | 1119-1141 |
| AD-288108.1 | GGUCUGUUUUCCUUUCAUGU | 1093 | 1164-1184 | ACAUGAAAGGAAAAACAGACCUA | 1393 | 1162-1184 |
| AD-288109.1 | GUCUGUUUUCCUUUCAUGCU | 1094 | 1165-1185 | AGCAUGAAAGGAAAAACAGACCU | 1394 | 1163-1185 |
| AD-288173.1 | UUAUUUACACAGGGAAGGUUU | 1095 | 1302-1322 | AAACCUUCCCUGUGUAAAUAAGU | 1395 | 1300-1322 |
| AD-288174.1 | UAUUUACACAGGGAAGGUUUA | 1096 | 1303-1323 | UAAACCUUCCCUGUGUAAAUAAG | 1396 | 1301-1323 |
| AD-288180.1 | GGGAAGGUUUAAGACUGUUCA | 1099 | 1313-1333 | UGAACAGUCUUAAACCUUCCCUG | 1399 | 1311-1333 |
| AD-288181.1 | GGAAGGUUUAAGACUGUUCAA | 1100 | 1314-1334 | UUGAACAGUCUUAAACCUUCCCU | 1400 | 1312-1334 |
| AD-288184.1 | UUUAAGACUGUUCAAGUAGCA | 1102 | 1320-1340 | UGCUACUUGAACAGUCUUAAACC | 1402 | 1318-1340 |
| AD-288187.1 | GACUGUUCAAGUAGCAUUCCA | 1104 | 1325-1345 | UGGAAUGCUACUUGAACAGUCUU | 1404 | 1323-1345 |
| AD-288188.1 | ACUGUUCAAGUAGCAUUCCAA | 1105 | 1326-1346 | UUGGAAUGCUACUUGAACAGUCU | 1405 | 1324-1346 |
| AD-288192.1 | CAAGUAGCAUUCCAAUCUGUA | 1108 | 1332-1352 | UACAGAUGGAAUGCUACUUGAA | 1408 | 1330-1352 |
| AD-288227.1 | AACUUAUUUACACAGGGAAGU | 1111 | 1299-1319 | ACUUCCCUGUGUAAAUAAGUUCU | 1411 | 1297-1319 |
| AD-288229.1 | UACACAGGGAAGGUUUAAGAU | 1112 | 1307-1327 | AUCUUAAACCUUCCCUGUGUAAA | 1412 | 1305-1327 |
| AD-288230.1 | CACAGGGAAGGUUUAAGACUU | 1113 | 1309-1329 | AAGUCUUAAACCUUCCCUGUGUA | 1413 | 1307-1329 |
| AD-288231.1 | AGGGAAGGUUUAAGACUGUUA | 1114 | 1312-1332 | AAACAGTCUUAAACCUUCCCUGU | 1414 | 1310-1332 |
| AD-288232.1 | GAAGGUUUAAGACUGUUCAAU | 1115 | 1315-1335 | AUUGAACAGUCUUAAACCUUCCC | 1415 | 1313-1335 |
| AD-288233.1 | GGUUUAAGACUGUUCAAGUAU | 1116 | 1318-1338 | AUACUUGAACAGUCUUAAACCUU | 1416 | 1316-1338 |
| AD-288235.1 | AAGACUGUUCAAGUAGCAUUU | 1117 | 1323-1343 | AAAUGCUACUUGAACAGUCUUAA | 1417 | 1321-1343 |
| AD-288236.1 | AGACUGUUCAAGUAGCAUUCU | 1118 | 1324-1344 | AGAAUGCUACUUGAACAGUCUUA | 1418 | 1322-1344 |
| AD-288237.1 | UGUUCAAGUAGCAUUCCAAU | 1119 | 1328-1348 | AAUUGGAAUGCUACUUGAACAGU | 1419 | 1326-1348 |
| AD-288238.1 | UUCAAGUAGCAUUCCAAUCUU | 1120 | 1330-1350 | AAGAUUGGAAUGCUACUUGAACA | 1420 | 1328-1350 |
| AD-288290.1 | GCAGCUUUAUCUCAACCUGGA | 1121 | 1419-1439 | UCCAGGUUGAGAUAAAGCUGCC | 1421 | 1417-1439 |
| AD-288316.1 | AGCAUUUGAAAGAUUUCCCUA | 1122 | 1455-1475 | UAGGGAAAUCUUUCAAAUGCUGA | 1422 | 1453-1475 |
| AD-288318.1 | UGAAAGAUUUCCCUAGCCUCU | 1123 | 1461-1481 | AGAGGCUAGGGAAAUCUUUCAAA | 1423 | 1459-1481 |
| AD-288324.1 | UUCCCUAGCCUCUUCCUUUUU | 1125 | 1469-1489 | AAAAAGGAAGAGGCUAGGGAAAU | 1425 | 1467-1489 |
| AD-288337.1 | AAGAACACAGAAUGAGUGCAU | 1126 | 1374-1394 | AUGCACUCAUUCUGUGUUCUUGU | 1426 | 1372-1394 |
| AD-288338.1 | GAACACAGAAUGAGUGCACAU | 1127 | 1376-1396 | AUGUGCACUCAUUCUGUGUUCUU | 1427 | 1374-1396 |
| AD-288339.1 | AACACAGAAUGAGUGCACAGU | 1128 | 1377-1397 | ACUGUGCACUCAUUCUGUGUUCU | 1428 | 1375-1397 |
| AD-288340.1 | CAGAAUGAGUGCACAGCUAAU | 1129 | 1381-1401 | AUUAGCTGUGCACUCAUUCUGUG | 1429 | 1379-1401 |
| AD-288341.1 | GAAUGAGUGCACAGCUAAGAU | 1130 | 1383-1403 | AUCUUAGCUGUGCACUCAUUCUG | 1430 | 1381-1403 |
| AD-288366.1 | UUCAGCAUUUGAAAGAUUUCU | 1131 | 1452-1472 | AGAAAUCUUUCAAAUGCUGAAUC | 1431 | 1450-1472 |
| AD-288369.1 | CAUUUGAAAGAUUUCCCUAGU | 1132 | 1457-1477 | ACUAGGGAAAUCUUUCAAAUGCU | 1432 | 1455-1477 |
| AD-288370.1 | AUUUGAAAGAUUUCCCUAGCU | 1133 | 1458-1478 | AGCUAGGGAAAUCUUUCAAAUGC | 1433 | 1456-1478 |
| AD-288394.1 | GUGCAACUCUAUUCUGGACUU | 1136 | 1505-1525 | AAGUCCAGAAUAGAGUUGCACCG | 1436 | 1503-1525 |
| AD-288396.1 | GCAACUCUAUUCUGGACUUUA | 1138 | 1507-1527 | UAAAGUCCAGAAUAGAGUUGCAC | 1438 | 1505-1527 |
| AD-288397.1 | CAACUCUAUUCUGGACUUUAU | 1139 | 1508-1528 | AUAAAGUCCAGAAUAGAGUUGCA | 1439 | 1506-1528 |
| AD-288427.1 | AGUCCACCAAAAGUGGACCCU | 1142 | 1559-1579 | AGGGUCCACUUUUGGUGGACUUC | 1442 | 1557-1579 |
| AD-288466.1 | AAACGGUGCAACUCUAUUCUU | 1148 | 1500-1520 | AAGAAUAGAGUUGCACCGUUUUG | 1448 | 1498-1520 |
| AD-288467.1 | AACGGUGCAACUCUAUUCUGU | 1149 | 1501-1521 | ACAGAAUAGAGUUGCACCGUUUU | 1449 | 1499-1521 |
| AD-288470.1 | UAUUCUGGACUUUAUUACUUU | 1150 | 1514-1534 | AAAGUAAUAAAGUCCAGAAUAGA | 1450 | 1512-1534 |
| AD-288491.1 | AAAGUGGACCCUCUAUAUUUC | 1151 | 1568-1588 | GAAAUAUAGAGGGUCCACUUUUG | 1451 | 1566-1588 |
| AD-288492.1 | AAGUGGACCCUCUAUAUUUCU | 1152 | 1569-1589 | AGAAAUAUAGAGGGUCCACUUUU | 1452 | 1567-1589 |
| AD-288561.1 | AUGUUUAGACAAUUUUAGGCU | 1153 | 1724-1744 | AGCCUAAAAUUGUCUAAACAUCU | 1453 | 1722-1744 |
| AD-288562.1 | GUUUAGACAAUUUUAGGCUCA | 1154 | 1726-1746 | UGAGCCUAAAAUUGUCUAAACAU | 1454 | 1724-1746 |
| AD-288567.1 | GACAAUUUUAGGCUCAAAAAU | 1159 | 1731-1751 | AUUUUUGAGCCUAAAAUUGUCUA | 1459 | 1729-1751 |
| AD-288573.1 | UAGGCUCAAAAAUUAAAGCUA | 1161 | 1739-1759 | UAGCUUUAAUUUUUGAGCCUAAA | 1461 | 1737-1759 |
| AD-288574.1 | AGGCUCAAAAAUUAAAGCUAA | 1162 | 1740-1760 | UUAGCUUUAAUUUUUGAGCCUAA | 1462 | 1738-1760 |
| AD-288575.1 | GCUCAAAAAUUAAAGCUAACA | 1163 | 1742-1762 | UGUUAGCUUUAAUUUUUGAGCCU | 1463 | 1740-1762 |
| AD-288576.1 | UCAAAAAUUAAAGCUAACACA | 1164 | 1744-1764 | UGUGUUAGCUUUAAUUUUUGAGC | 1464 | 1742-1764 |
| AD-288613.1 | UUCAUAUAUCCUUGGUCCCAU | 1165 | 1701-1721 | AUGGGACCAAGGAUAUAUGAAAG | 1465 | 1699-1721 |
| AD-288620.1 | GAUGUUUAGACAAUUUUAGGU | 1166 | 1723-1743 | ACCUAAAAUUGUCUAAACAUCUC | 1466 | 1721-1743 |
| AD-288624.1 | GGCUCAAAAAUUAAAGCUAAU | 1167 | 1741-1761 | AUUAGCUUUAAUUUUUGAGCCUA | 1467 | 1739-1761 |
| AD-288625.1 | CUCAAAAAUUAAAGCUAACAU | 1168 | 1743-1763 | AUGUAGCUUUAAUUUUUGAGCCU | 1468 | 1741-1763 |
| AD-288626.1 | CAAAAAUUAAAGCUAACACAU | 1169 | 1745-1765 | AUGUGUAGCUUUAAUUUUUGAG | 1469 | 1743-1765 |
| AD-288628.1 | AAAUUAAAGCUAACACAGGAA | 1170 | 1748-1768 | UUCCUGTGUUAGCUUUAAUUUUU | 1470 | 1746-1768 |
| AD-288634.1 | UAACACAGGAAAAGGAACUGU | 1171 | 1758-1778 | ACAGUUCCUUUUCCUGUGUUAGC | 1471 | 1756-1778 |
| AD-288637.1 | GGAAAAGGAACUGUACUGGCU | 1172 | 1765-1785 | AGCCAGUACAGUUCCUUUUCCUG | 1472 | 1763-1785 |
| AD-288696.1 | CAGGAAAAGGAACUGUACUGU | 1175 | 1763-1783 | ACAGUACAGUUCCUUUUCCUGUG | 1475 | 1761-1783 |
| AD-288698.1 | AGGAACUGUACUGGCUAUUAU | 1176 | 1770-1790 | AUAAUAGCCAGUACAGUUCCUUU | 1476 | 1768-1790 |
| AD-288912.1 | CUCCCACUACAUCAAGACUAA | 1177 | 2189-2209 | UUAGUCUUGAUGUAGUGGGAGUC | 1477 | 2187-2209 |
| AD-288915.1 | CACUACAUCAAGACUAAUCUU | 1180 | 2193-2213 | AAGAUUAGUCUUGAUGUAGUGGG | 1480 | 2191-2213 |
| AD-288916.1 | CUACAUCAAGACUAAUCUUGU | 1181 | 2195-2215 | ACAAGAUUAGUCUUGAUGUAGUG | 1481 | 2193-2215 |
| AD-288933.1 | GUGUUUUCACAUGUAUUAUA | 1184 | 2221-2241 | UAUAAUACAUGUGAAAAACACAC | 1484 | 2219-2241 |
| AD-288937.1 | UCACAUGUAUUAUAGAAUGCU | 1185 | 2228-2248 | AGCAUUCUAUAAUACAUGUGAAA | 1485 | 2226-2248 |
| AD-288938.1 | CACAUGUAUUAUAGAAUGCUU | 1186 | 2229-2249 | AAGCAUUCUAUAAUACAUGUGAA | 1486 | 2227-2249 |
| AD-288948.1 | CUUUUGCAUGGACUAUCCUCU | 1192 | 2247-2267 | AGAGGAUAGUCCAUGCAAAAGCA | 1492 | 2245-2267 |
| AD-288950.1 | UUGCAUGGACUAUCCUCUUGU | 1193 | 2250-2270 | ACAAGAGGAUAGUCCAUGCAAAA | 1493 | 2248-2270 |
| AD-288956.1 | GGACUAUCCUCUUGUUUUUAU | 1196 | 2256-2276 | AUAAAAACAAGAGGAUAGUCCAU | 1496 | 2254-2276 |

TABLE 8-continued

HSD17B13 ELF7 GNA7 Unmodified Sequence*

| Duplex Name | Sense sequence 5' to 3' | SEQ ID NO: | Position in NM_178135.4 | Antisense sequence 5' to 3' | SEQ ID NO: | Position in NM_178135.4 |
|---|---|---|---|---|---|---|
| AD-288957.1 | GACUAUCCUCUUGUUUUUAUU | 1197 | 2257-2277 | AAUAAAAACAAGAGGAUAGUCCA | 1497 | 2255-2277 |
| AD-288959.1 | CUAUCCUCUUGUUUUUAUUAA | 1198 | 2259-2279 | UUAAUAAAAACAAGAGGAUAGUC | 1498 | 2257-2279 |
| AD-288981.1 | CCCACUACAUCAAGACUAAUU | 1199 | 2191-2211 | AAUUAGTCUUGAUGUAGUGGGAG | 1499 | 2189-2211 |
| AD-288982.1 | ACUACAUCAAGACUAAUCUUU | 1200 | 2194-2214 | AAAGAUUAGUCUUGAUGUAGUGG | 1500 | 2192-2214 |
| AD-288996.1 | AUGCUUUUGCAUGGACUAUCU | 1201 | 2244-2264 | AGAUAGTCCAUGCAAAAGCAUUC | 1501 | 2242-2264 |

*Target: HSD17B13

TABLE 9

HSD17B13 ELF GNA7 in vitro 10 nM screen in Cos-7 (Human Dual-Luciferase psiCHECK2 vector) and Primary Cynomolgus Hepatocytes

| Duplex Name | % of Human Message Remaining 10 nM | % of Human Message Remaining 0.1 nM | % of Cyno Message remaining 10 nM | % of Cyno Message remaining 0.1 nM |
|---|---|---|---|---|
| AD-286958.1 | 108.7 | 111.4 | 84.5 | 99.1 |
| AD-287001.1 | 84.8 | 98.4 | 14.7 | 81.4 |
| AD-287012.1 | 88.6 | 110 | 97.1 | 88.8 |
| AD-287014.1 | 95.2 | 105.8 | 116.5 | 102.3 |
| AD-287015.1 | 65.4 | 93.8 | 14.5 | 80.3 |
| AD-287017.1 | 98.5 | 94.9 | 91.6 | 96.2 |
| AD-287026.1 | 31.9 | 91 | 44.8 | 73.6 |
| AD-287059.1 | 76.9 | 117.2 | 70 | 94.4 |
| AD-287060.1 | 101.6 | 97.9 | 71.1 | 97.8 |
| AD-287061.1 | 94.6 | 92.8 | 60.5 | 96.4 |
| AD-287062.1 | 90.8 | 97.7 | 67.1 | 113.1 |
| AD-287064.1 | 97 | 92.5 | 75 | 98.2 |
| AD-287065.1 | 92.2 | 98.2 | 74.4 | 98 |
| AD-287066.1 | 98.5 | 96.4 | 27 | 99.3 |
| AD-287126.1 | 95.6 | 99.9 | 19.1 | 93.5 |
| AD-287200.1 | 98.7 | 126.7 | 91.5 | 95.3 |
| AD-287201.1 | 38.7 | 101.6 | 88.6 | 100.6 |
| AD-287202.1 | 74.5 | 97.2 | 88.7 | 100.7 |
| AD-287203.1 | 72.9 | 98.7 | 50.3 | 87.1 |
| AD-287205.1 | 72.8 | 98 | 40 | 96.9 |
| AD-287206.1 | 62.7 | 112.9 | 19.6 | 88.4 |
| AD-287227.1 | 64.3 | 95 | 34.2 | 95.1 |
| AD-287246.1 | 58.1 | 97.5 | 20.8 | 72.4 |
| AD-287247.1 | 76.2 | 95.9 | 84.8 | 115.1 |
| AD-287248.1 | 65.5 | 110.9 | 55 | 92 |
| AD-287249.1 | 90.1 | 107.8 | 126.6 | 113.4 |
| AD-287250.1 | 76.9 | 113.2 | 96.2 | 95.6 |
| AD-287251.1 | 35.8 | 92.3 | 53.5 | 93.7 |
| AD-287252.1 | 57.7 | 89 | 32.7 | 101.4 |
| AD-287253.1 | 76.1 | 95 | 74.1 | 92.6 |
| AD-287254.1 | 104.7 | 124 | 89.5 | 100.5 |
| AD-287258.1 | 91.4 | 107.8 | 44.9 | 98.1 |
| AD-287287.1 | 55.2 | 96.5 | 65.7 | 104.4 |
| AD-287288.1 | 53.1 | 96.9 | 36 | 108.3 |
| AD-287289.1 | 77.3 | 98.1 | 57.5 | 97.8 |
| AD-287290.1 | 23.5 | 103.2 | 55.3 | 82.8 |
| AD-287293.1 | 46.6 | 89.5 | 88.6 | 102.2 |
| AD-287316.1 | 78.6 | 82.4 | 34.1 | 92.4 |
| AD-287320.1 | 86.2 | 88.8 | 105.8 | 97.9 |
| AD-287321.1 | 86 | 108.2 | 81.3 | 91 |
| AD-287324.1 | 72.7 | 113.6 | 34.3 | 107.8 |
| AD-287325.1 | 78.4 | 104.6 | 85.2 | 86.2 |
| AD-287326.1 | 39.2 | 95.1 | 17.3 | 73.3 |
| AD-287327.1 | 91.7 | 95.2 | 99.6 | 90.4 |
| AD-287344.1 | 13.6 | 81.4 | 14.4 | 58.3 |
| AD-287346.1 | 115.2 | 122.2 | 96.5 | 103.1 |
| AD-287347.1 | 43.3 | 89.6 | 26.3 | 86.7 |
| AD-287366.1 | 53 | 98.4 | 36.1 | 90.1 |
| AD-287367.1 | 102.8 | 99.3 | 98.4 | 93.3 |
| AD-287370.1 | 107.7 | 106.7 | 102.1 | 93.8 |
| AD-287371.1 | 79.2 | 107 | 81.6 | 93.5 |
| AD-287372.1 | 101.8 | 103.2 | 94.4 | 108.4 |
| AD-287373.1 | 67.5 | 85.9 | 28.7 | 89.6 |
| AD-287374.1 | 60.7 | 103.2 | 63.2 | 83.2 |
| AD-287375.1 | 96 | 101 | 85.3 | 98 |
| AD-287391.1 | 28.3 | 92 | 26.4 | 95.3 |
| AD-287392.1 | 33.8 | 100.9 | 31.4 | 90.8 |
| AD-287406.1 | 93.2 | 106.5 | 54.1 | 96.2 |
| AD-287407.1 | 47.5 | 86.1 | 23.6 | 72.2 |
| AD-287408.1 | 63.1 | 90.3 | 47.1 | 98.2 |
| AD-287410.1 | 32.5 | 87.6 | 10.9 | 80.2 |
| AD-287411.1 | 21.6 | 87.3 | 10 | 69.1 |
| AD-287413.1 | 87.4 | 98.2 | 72.7 | 89.9 |
| AD-287414.1 | 100.6 | 97.3 | 100.2 | 98.6 |
| AD-287415.1 | 20.2 | 88.9 | 9.7 | 68.8 |
| AD-287418.1 | 13.3 | 88.8 | 45.9 | 66.6 |
| AD-287419.1 | 54.6 | 99.7 | 58.7 | 88 |
| AD-287421.1 | 27.4 | 94.7 | 7.4 | 66.2 |
| AD-287424.1 | 33.4 | 98 | 40.6 | 87.6 |
| AD-287427.1 | 67.9 | 106.6 | 24.2 | 75.8 |
| AD-287428.1 | 79.1 | 94.5 | 22.3 | 84.7 |
| AD-287429.1 | 99.5 | 98.2 | 53.8 | 94.7 |
| AD-287430.1 | 101.9 | 104 | 88.3 | 103.9 |
| AD-287441.1 | 62.8 | 104 | 61.1 | 103.6 |
| AD-287453.1 | 19.9 | 91.5 | 12.5 | 70.3 |
| AD-287462.1 | 44.1 | 90.3 | 85.1 | 93.1 |
| AD-287463.1 | 93.9 | 99.9 | 78.3 | 100.4 |
| AD-287464.1 | 113 | 107.9 | 51.5 | 110.6 |
| AD-287465.1 | 86.6 | 99 | 80.4 | 101.5 |
| AD-287466.1 | 89.9 | 96.4 | 106.2 | 109.7 |
| AD-287467.1 | 85.2 | 100.4 | 82.2 | 107.9 |
| AD-287468.1 | 36.6 | 102.8 | 13.7 | 92.4 |
| AD-287469.1 | 67.5 | 93.6 | 88.5 | 107.8 |
| AD-287470.1 | 30 | 111.3 | 24.9 | 68.2 |
| AD-287474.1 | 61.6 | 103.1 | 55.4 | 93.3 |
| AD-287476.1 | 33.2 | 120.5 | 29.2 | 52 |
| AD-287477.1 | 62.3 | 90.6 | 38.2 | 81.3 |
| AD-287478.1 | 44 | 86.3 | 6.1 | 52.5 |
| AD-287479.1 | 89.8 | 95.8 | 53 | 95.1 |
| AD-287491.1 | 63.1 | 108.1 | 75.7 | 92.2 |
| AD-287492.1 | 70.8 | 92.9 | 93.6 | 97.1 |
| AD-287517.1 | 75.2 | 93.3 | 98 | 99.5 |
| AD-287520.1 | 73.9 | 97.9 | 96.2 | 101.9 |
| AD-287521.1 | 50.1 | 94.6 | 70.2 | 98.7 |
| AD-287522.1 | 88.9 | 109.4 | 83.4 | 91.8 |
| AD-287524.1 | 14.4 | 111.5 | 31.1 | 65.9 |
| AD-287525.1 | 71.6 | 104.4 | 88.6 | 103.8 |
| AD-287537.1 | 51.6 | 110.5 | 20.5 | 84.7 |
| AD-287539.1 | 47.9 | 115.9 | 27.9 | 78.5 |
| AD-287540.1 | 74.9 | 105.1 | 19.6 | 86.2 |
| AD-287543.1 | 47.6 | 95.3 | 12.7 | 93.3 |
| AD-287546.1 | 65.7 | 102.8 | 6.8 | 59 |
| AD-287568.1 | 74.8 | 104.6 | 56.7 | 100.7 |
| AD-287591.1 | 40 | 100.8 | 12.7 | 65.1 |

TABLE 9-continued

HSD17B13 ELF GNA7 in vitro 10 nM screen in Cos-7 (Human Dual-Luciferase psiCHECK2 vector) and Primary Cynomolgus Hepatocytes

| Duplex Name | % of Human Message Remaining 10 nM | % of Human Message Remaining 0.1 nM | % of Cyno Message remaining 10 nM | % of Cyno Message remaining 0.1 nM |
|---|---|---|---|---|
| AD-287610.1 | 33.3 | 78.1 | 32.3 | 66.4 |
| AD-287615.1 | 24.4 | 104.8 | 12.5 | 68.7 |
| AD-287616.1 | 15.7 | 102 | 16.1 | 63.6 |
| AD-287627.1 | 81.3 | 92.3 | 111.8 | 94.5 |
| AD-287632.1 | 93.9 | 93.1 | 88.9 | 106.9 |
| AD-287633.1 | 106.4 | 91.9 | 68.4 | 122.6 |
| AD-287634.1 | 82.3 | 114.7 | 78.7 | 94.5 |
| AD-287636.1 | 21.8 | 97.7 | 18.9 | 56.5 |
| AD-287637.1 | 27.6 | 92.3 | 22.8 | 91.4 |
| AD-287638.1 | 99 | 101.2 | 101.6 | 98.1 |
| AD-287647.1 | 74.2 | 108.2 | 74.5 | 94.3 |
| AD-287648.1 | 12.9 | 92.8 | 29.8 | 61 |
| AD-287651.1 | 66.5 | 100.6 | 92.8 | 106.4 |
| AD-287652.1 | 12.8 | 79.5 | 11.5 | 66.2 |
| AD-287653.1 | 18.9 | 69.8 | 17.9 | 87.7 |
| AD-287654.1 | 87.5 | 101 | 75.4 | 91.4 |
| AD-287655.1 | 61.6 | 101.7 | 88.3 | 98 |
| AD-287656.1 | 91.7 | 122.5 | 86.4 | 97.9 |
| AD-287658.1 | 78.1 | 118.7 | 45 | 89.4 |
| AD-287659.1 | 37 | 100.9 | 22.1 | 87.2 |
| AD-287679.1 | 55.4 | 93.6 | 24.4 | 85.1 |
| AD-287680.1 | 14.3 | 114.1 | 17.4 | 35.8 |
| AD-287683.1 | 59 | 94.1 | 33.3 | 87.5 |
| AD-287690.1 | 81.2 | 144.4 | 49.9 | 93.5 |
| AD-287693.1 | 68.7 | 125.5 | 85.8 | 100.5 |
| AD-287694.1 | 100.2 | 111.7 | 87.8 | 101.8 |
| AD-287695.1 | 88.4 | 110.2 | 89.2 | 106.1 |
| AD-287696.1 | 13.8 | 78.3 | 12 | 63.6 |
| AD-287700.1 | 15.6 | 97 | 22.9 | 82.3 |
| AD-287701.1 | 46.1 | 95 | 108.7 | 109.1 |
| AD-287702.1 | 80.1 | 112.2 | 80.1 | 93.9 |
| AD-287703.1 | 70.1 | 102.6 | 92.2 | 105.5 |
| AD-287704.1 | 38.2 | 113.8 | 25.4 | 95.5 |
| AD-287706.1 | 94.3 | 105 | 96.1 | 97.8 |
| AD-287707.1 | 82.6 | 114.2 | 103.2 | 106.7 |
| AD-287709.1 | 78.2 | 93.8 | 89.9 | 103.9 |
| AD-287711.1 | 23.1 | 76.9 | 15.5 | 88.1 |
| AD-287724.1 | 54.2 | 94.9 | 100.4 | 97.6 |
| AD-287725.1 | 83.1 | 116.3 | 61.8 | 101.3 |
| AD-287726.1 | 20.8 | 77.6 | 15.5 | 70.6 |
| AD-287727.1 | 33.6 | 111 | 27.9 | 57.1 |
| AD-287728.1 | 28.8 | 107 | 11.2 | 76.6 |
| AD-287735.1 | 13.2 | 92.7 | 9.6 | 25.6 |
| AD-287736.1 | 60.7 | 111 | 26.9 | 83.8 |
| AD-287737.1 | 71.3 | 98.7 | 42.5 | 105.1 |
| AD-287738.1 | 31.3 | 114.3 | 21.8 | 87.8 |
| AD-287739.1 | 22.5 | 101.9 | 55 | 72 |
| AD-287740.1 | 16.3 | 73.5 | 19 | 55.7 |
| AD-287778.1 | 82.4 | 113.7 | 66.4 | 90.9 |
| AD-287793.1 | 47.8 | 91.5 | 84.1 | 92.9 |
| AD-287795.1 | 32.9 | 99.6 | 54.4 | 102.2 |
| AD-287798.1 | 48.8 | 98.3 | 18.5 | 90.5 |
| AD-287800.1 | 59.4 | 96.3 | 58.7 | 95.1 |
| AD-287801.1 | 17.7 | 140.3 | 16.1 | 71.4 |
| AD-287802.1 | 5.6 | 82.9 | 17 | 27.8 |
| AD-287804.1 | 14.7 | 77.5 | 14.3 | 70.3 |
| AD-287810.1 | 53.9 | 98.6 | 72.5 | 100.1 |
| AD-287811.1 | 64.5 | 106 | 33.9 | 90.2 |
| AD-287813.1 | 35.9 | 114.4 | 17.9 | 91.4 |
| AD-287837.1 | 11.6 | 66 | 9.3 | 58 |
| AD-287839.1 | 95.3 | 106.1 | 60 | 136.1 |
| AD-287841.1 | 13.4 | 98.7 | 22.9 | 46.4 |
| AD-287842.1 | 94.6 | 89.9 | 106.1 | 97.5 |
| AD-287844.1 | 87.4 | 161.1 | 74 | 88.1 |
| AD-287854.1 | 32.4 | 103.1 | 25.2 | 82.8 |
| AD-287856.1 | 16.9 | 99.3 | 32.4 | 64.5 |
| AD-287857.1 | 88 | 99.4 | 64.7 | 106.2 |
| AD-287893.1 | 17.2 | 94.7 | 58.7 | 93.2 |
| AD-287917.1 | 30.5 | 114.1 | 60 | 69.4 |
| AD-287924.1 | 52.3 | 85.6 | 75.3 | 86.5 |
| AD-287934.1 | 48.5 | 91.3 | 39.4 | 96.8 |
| AD-287969.1 | 100.3 | 96.7 | 77.9 | 105.5 |
| AD-287970.1 | 15.4 | 88.3 | 43 | 87.6 |
| AD-287982.1 | 73.8 | 87.6 | 26.7 | 56.3 |
| AD-288005.1 | 23.6 | 92.4 | 69.9 | 88.4 |
| AD-288006.1 | 28.8 | 91.1 | 52.8 | 95.3 |
| AD-288008.1 | 62.6 | 111.1 | 52 | 97.5 |
| AD-288010.1 | 66.8 | 116.2 | 66.1 | 102 |
| AD-288011.1 | 11.7 | 78 | 45.2 | 54.5 |
| AD-288015.1 | 27.1 | 111.4 | 66.6 | 61 |
| AD-288046.1 | 12.2 | 72.4 | 20.7 | 53.5 |
| AD-288049.1 | 44.9 | 104.5 | 68.6 | 77.3 |
| AD-288050.1 | 32.2 | 120.1 | 41.8 | 70.6 |
| AD-288076.1 | 43.1 | 109.1 | 24.2 | 66.4 |
| AD-288092.1 | 10.9 | 106.6 | 58.5 | 113.2 |
| AD-288094.1 | 66.8 | 92.3 | 90.4 | 91.6 |
| AD-288095.1 | 16.2 | 92.4 | 39 | 55.5 |
| AD-288108.1 | 53.3 | 122.8 | 49.1 | 96.7 |
| AD-288109.1 | 39.8 | 114.6 | 51 | 90.4 |
| AD-288173.1 | 19.3 | 110.7 | 58.8 | 81.1 |
| AD-288174.1 | 39 | 90.1 | 71.8 | 88.7 |
| AD-288176.1 | 135.9 | 92.9 | 102.6 | 106 |
| AD-288177.1 | 91.4 | 99.7 | 57.2 | 99.5 |
| AD-288180.1 | 34.5 | 110 | 68 | 82 |
| AD-288181.1 | 19.9 | 116.4 | 34.6 | 74.9 |
| AD-288183.1 | 38.2 | 96.5 | 20.5 | 84.6 |
| AD-288184.1 | 43.4 | 95 | 28.9 | 84.1 |
| AD-288186.1 | 63.9 | 107.4 | 60.7 | 88 |
| AD-288187.1 | 22.9 | 113.8 | 53 | 84.5 |
| AD-288188.1 | 16.3 | 77.6 | 23.4 | 60.5 |
| AD-288189.1 | 47.2 | 104.1 | 22.4 | 49.3 |
| AD-288190.1 | 21.5 | 81.3 | 22.8 | 58.1 |
| AD-288192.1 | 71.7 | 112.4 | 76.6 | 93.6 |
| AD-288193.1 | 62.5 | 118.5 | 34 | 72.8 |
| AD-288194.1 | 66.7 | 96.6 | 31.2 | 87.1 |
| AD-288227.1 | 86.5 | 85.7 | 113.1 | 103.6 |
| AD-288229.1 | 104.6 | 103.1 | 73.7 | 88.6 |
| AD-288230.1 | 32.5 | 122.3 | 29.7 | 75.1 |
| AD-288231.1 | 19 | 100.2 | 46.5 | 72.1 |
| AD-288232.1 | 66.9 | 95.5 | 97 | 95.2 |
| AD-288233.1 | 26.2 | 108 | 21.1 | 68.6 |
| AD-288235.1 | 7.4 | 79.8 | 39.3 | 52.6 |
| AD-288236.1 | 18.1 | 78.8 | 21.5 | 51.6 |
| AD-288237.1 | 59.8 | 133.8 | 37.3 | 72.6 |
| AD-288238.1 | 10.4 | 57.4 | 21.3 | 58.1 |
| AD-288290.1 | 68.9 | 108.4 | 29.8 | 90.7 |
| AD-288316.1 | 38 | 98.2 | 42.2 | 61.8 |
| AD-288318.1 | 37.6 | 99.4 | 25.3 | 66 |
| AD-288319.1 | 23.7 | 93.5 | 44.4 | 90.4 |
| AD-288324.1 | 56.4 | 146.7 | 51.7 | 81.8 |
| AD-288337.1 | 24.7 | 94.5 | 30 | 78 |
| AD-288338.1 | 34.8 | 95.6 | 46.9 | 68.3 |
| AD-288339.1 | 67.3 | 86.5 | 78.5 | 94 |
| AD-288340.1 | 19.5 | 114.6 | 29.5 | 51.7 |
| AD-288341.1 | 23.1 | 88.9 | 48.8 | 75.7 |
| AD-288366.1 | 34.6 | 160.9 | 42.9 | 91.4 |
| AD-288369.1 | 16.4 | 120.9 | 28.2 | 77.4 |
| AD-288370.1 | 15.1 | 73.8 | 26.8 | 89.1 |
| AD-288391.1 | 30.1 | 84 | 21.2 | 64.5 |
| AD-288393.1 | 56 | 96.6 | 41.8 | 101.9 |
| AD-288394.1 | 20.1 | 107 | 48.5 | 75.6 |
| AD-288395.1 | 64 | 94.8 | 53.7 | 101 |
| AD-288396.1 | 86 | 94.3 | 100.2 | 90.7 |
| AD-288397.1 | 28.3 | 83.9 | 33.9 | 83.9 |
| AD-288398.1 | 63.4 | 108.8 | 87.6 | 91.7 |
| AD-288402.1 | 60.1 | 103.7 | 37 | 89.3 |
| AD-288427.1 | 110.8 | 95.6 | 89.8 | 97.2 |
| AD-288430.1 | 94.7 | 118.3 | 85.2 | 92.7 |
| AD-288431.1 | 87.4 | 94.7 | 106.5 | 94.5 |
| AD-288432.1 | 39 | 112.5 | 81.6 | 88.7 |

TABLE 9-continued

HSD17B13 ELF GNA7 in vitro 10 nM screen in Cos-7 (Human Dual-Luciferase psiCHECK2 vector) and Primary Cynomolgus Hepatocytes

| Duplex Name | % of Human Message Remaining 10 nM | % of Human Message Remaining 0.1 nM | % of Cyno Message remaining 10 nM | % of Cyno Message remaining 0.1 nM |
|---|---|---|---|---|
| AD-288433.1 | 100.7 | 113 | 107.9 | 92.4 |
| AD-288434.1 | 104.8 | 99.6 | 87.5 | 102.3 |
| AD-288466.1 | 65 | 99.1 | 77.1 | 100 |
| AD-288467.1 | 99.4 | 99.8 | 64.9 | 98.6 |
| AD-288470.1 | 30.7 | 97.7 | 82.9 | 83.8 |
| AD-288491.1 | 82.6 | 98.5 | 69.8 | 90.6 |
| AD-288492.1 | 77 | 98.1 | 84.5 | 106.6 |
| AD-288561.1 | 54.5 | 92.2 | 102.4 | 103.6 |
| AD-288562.1 | 35.9 | 91.8 | 32.2 | 89.5 |
| AD-288563.1 | 18.7 | 79.9 | 29.9 | 69.1 |
| AD-288564.1 | 24.5 | 68.1 | 38.3 | 80.9 |
| AD-288565.1 | 47.1 | 97.6 | 53.9 | 83.8 |
| AD-288566.1 | 33.7 | 89.8 | 30.5 | 64.6 |
| AD-288567.1 | 75.7 | 92.5 | 101.7 | 99.7 |
| AD-288572.1 | 93.2 | 97.6 | 92 | 110.6 |
| AD-288573.1 | 51.9 | 95 | 46.3 | 86.1 |
| AD-288574.1 | 12.6 | 79.8 | 25.8 | 54.3 |
| AD-288575.1 | 51.2 | 116.2 | 61.7 | 76.2 |
| AD-288576.1 | 26.9 | 98 | 51.7 | 75 |
| AD-288613.1 | 36 | 92.1 | 103.9 | 113.2 |
| AD-288620.1 | 62.8 | 94.8 | 107 | 88.5 |
| AD-288624.1 | 26.8 | 101.4 | 32.2 | 66.8 |
| AD-288625.1 | 16.4 | 99.3 | 40.5 | 73.2 |
| AD-288626.1 | 34.7 | 100.9 | 30.1 | 70.8 |
| AD-288628.1 | 32.7 | 85.2 | 35.1 | 80.2 |
| AD-288634.1 | 89.6 | 92.6 | 77 | 90.6 |
| AD-288637.1 | 44.5 | 93.6 | 42.1 | 104 |
| AD-288639.1 | 43.7 | 112 | 20.6 | 46.7 |
| AD-288642.1 | 42.2 | 99.6 | 25.2 | 69.8 |
| AD-288696.1 | 52.8 | 101.5 | 31.1 | 88 |
| AD-288698.1 | 16.3 | 75.6 | 21 | 58.9 |
| AD-288912.1 | 21.1 | 83.4 | 23.2 | 56.1 |
| AD-288913.1 | 28.5 | 88 | 26.7 | 65.9 |
| AD-288914.1 | 16.1 | 77.7 | 23.1 | 56.1 |
| AD-288915.1 | 17.7 | 92.8 | 33.9 | 73.6 |
| AD-288916.1 | 16.1 | 91.1 | 24 | 75.5 |
| AD-288917.1 | 15.1 | 59.6 | 31 | 77 |
| AD-288918.1 | 23.6 | 85.2 | 35.2 | 98.8 |
| AD-288933.1 | 24.9 | 78.9 | 62.9 | 78.8 |
| AD-288937.1 | 74.3 | 103.3 | 51.6 | 89.9 |
| AD-288938.1 | 28.2 | 105.7 | 42.9 | 92.7 |
| AD-288941.1 | 33.1 | 100 | 44.9 | 114.1 |
| AD-288943.1 | 69.7 | 97.2 | 49.1 | 89 |
| AD-288945.1 | 25.1 | 83.4 | 26.1 | 64.4 |
| AD-288946.1 | 54 | 89.5 | 45.5 | 82.9 |
| AD-288947.1 | 26.7 | 97.6 | 26.6 | 76.9 |
| AD-288948.1 | 18.2 | 93.6 | 24.7 | 67.6 |
| AD-288950.1 | 24.3 | 103.4 | 31.8 | 89.7 |
| AD-288951.1 | 18.9 | 85.3 | 29.7 | 96.5 |
| AD-288952.1 | 98.1 | 103.2 | 85.4 | 92.9 |
| AD-288956.1 | 30.5 | 104 | 53 | 84.5 |
| AD-288957.1 | 23.4 | 88.8 | 57.9 | 85.2 |
| AD-288959.1 | 21.5 | 82.5 | 45.7 | 64.4 |
| AD-288981.1 | 63.2 | 101.9 | 26.6 | 73.5 |
| AD-288982.1 | 82.9 | 103.7 | 50.2 | 88.4 |
| AD-288996.1 | 11.6 | 70.8 | 39.3 | 70.3 |

TABLE 10

HSD17B13 NonF DNA Modified Sequence*

| Duplex Name | Sense sequence 5' to 3' | SEQ ID NO: | Antisense sequence 5' to 3' | SEQ ID NO: |
|---|---|---|---|---|
| AD-291929.1 | ascsacaaggdAcdTgaaccagaauL96 | 1502 | asdTsucdTgdGuucadGudCcuugugusasg | 1797 |
| AD-291931.1 | ascsaaggacdTgdAaccagaaggaL96 | 1503 | usdCscudTcdTgguudCadGuccuugusgsu | 1798 |
| AD-291988.1 | uscscuucugdCudTcugaucaccaL96 | 1504 | usdGsgudGadTcagadAgdCagaaggasusu | 1799 |
| AD-291993.1 | csusgcuucugdGadTcaccaucauuL96 | 1505 | asdAsugdAudGgugadTcdAaagcagsasa | 1800 |
| AD-291998.1 | uscsugaucadCcdAucaucuacuuL96 | 1506 | asdAsgudAgdAugaudGgdTgaucagasasg | 1801 |
| AD-292005.1 | ascscaucaudCudAcuccuacuuuL96 | 1507 | asdAsagdTadGgagudAgdAuganggusgsa | 1802 |
| AD-292006.1 | cscsaucaucdTadCuccuacuuguL96 | 1508 | asdCsaadGudAggagdTadGaugauggsusg | 1803 |
| AD-292007.1 | csasucaucudAcdTccuacuuggaL96 | 1509 | usdCscadAgdTaggadGudAgaugaugsgsu | 1804 |
| AD-292008.1 | asuscaucuadCudCcuacuuggauL96 | 1510 | asdTsccdAadGuaggdAgdTagaugausgsg | 1805 |
| AD-292010.1 | csasucuacudCcdTacuuggaguuL96 | 1511 | asdAscudCcdAaguadGgdAguagaugsasu | 1806 |
| AD-292012.1 | uscsuacuccdTadCuuggagucguL96 | 1512 | asdCsgadCudCcaagdTadGgaguagasusg | 1807 |
| AD-292013.1 | csusacuccudAcdTuggagucguuL96 | 1513 | asdAscgdAcdTccaadGudAggaguagsasu | 1808 |
| AD-292014.1 | usascuccuadCudTggagucguuuL96 | 1514 | asdAsacdGadCuccadAgdTaggaguasgsa | 1809 |
| AD-292015.1 | ascsuccuacdTudGgagucguuguL96 | 1515 | asdCsaadGdAcuccdAadGuaggagusasg | 1810 |
| AD-292016.1 | csusccuacudTgdGagucguugguL96 | 1516 | asdCscadAcdGacucdCadAguaggagsusa | 1811 |
| AD-292017.1 | uscscuacuudGgdAgucguugguuL96 | 1517 | asdAscccdAadCgacudCcdAaguaggasgsu | 1812 |
| AD-292028.1 | gsuscguuggdTgdAaguuuucauL96 | 1518 | asdTsgadAadAacuudCadCcaacgacsusc | 1813 |
| AD-292137.1 | ususgguucudGudGgggauauuaauL96 | 1519 | asdTsuadAudAucccdAcdAgaaccaasusa | 1814 |
| AD-292140.1 | gsusucugugdGgdAuauuaauaauL96 | 1520 | asdTsuadTudAauaudCcdCacagaacscsa | 1815 |
| AD-292143.1 | csusgugggadTadTuaauaageguL96 | 1521 | asdCsgcdTudAuuaadTadTcccacagsasa | 1816 |
| AD-292182.1 | gscsugaugdCcdGaaaacuagguL96 | 1522 | asdCscudAgdTuuucdGgdCacucagcsusg | 1817 |
| AD-292183.1 | csusgagugcdCgdAaaacuaggcuL96 | 1523 | asdGsccdTadGuuuudCgdGcacucagscsu | 1818 |
| AD-292185.1 | gsasgugccgdAadAacuaggcguuL96 | 1524 | asdAscgdCcdTaguudTudCggcacucsasg | 1819 |
| AD-292186.1 | asgsugccgadAadAacuaggcgucaL96 | 1525 | usdGsacdGcdCuagudTudTcggcacuscsa | 1820 |
| AD-292187.1 | gsusgccgaadAadCuaggcgucacL96 | 1526 | asdTsgadCgdCcuagdTudTucggcacsusc | 1821 |
| AD-292188.1 | usgsccgaaaadAcdTaggcgucacuL96 | 1527 | asdGsugdAcdGccuadGudTuucggcascsu | 1822 |
| AD-292189.1 | gscsgaaaadCudAggcgucacuuL96 | 1528 | asdAsgudGadCgccudAgdTuuucggcsasc | 1823 |
| AD-292190.1 | cscsgaaaacdTadGgcgucacuguL96 | 1529 | asdCsagdTgdAcgccdTadGuuuucggscsa | 1824 |
| AD-292238.1 | csasgagaagdAgdAucuacguuL96 | 1530 | asdAsgedGadTagaudCudCuucucugsusu | 1825 |
| AD-292244.1 | asgsagaucudAudCgcucucuaaaL96 | 1531 | usdTsuadGadGagcgdAudAgaucucususc | 1826 |

TABLE 10-continued

HSD17B13 NonF DNA Modified Sequence*

| | | | | | |
|---|---|---|---|---|---|
| AD-292245.1 | gsasgaucuadTcdGcucucuaaauL96 | 1532 | asdTsuudAgdAgagedGadTagaucucsusu | 1827 |
| AD-292247.1 | gsasucuaucdGcdTcucuaaaucaL96 | 1533 | usdGsaudTudAgagadGcdGauagaucsusc | 1828 |
| AD-292248.1 | asuscuaucgcdCudCucuaaaucauL96 | 1534 | asdTsgadTudTagagdAgdCgauagauscsu | 1829 |
| AD-292250.1 | csusaucgcudCudCuuaaaucagguL96 | 1535 | asdCscudGadTuuagdAgdAgcgauagsasu | 1830 |
| AD-292251.1 | usasucgcucdTcdTaaaucagguuL96 | 1536 | asdAsccdTgdAuuuadGadGagcgauagsga | 1831 |
| AD-292252.1 | asuscgcucucdCudAaaucaggugaL96 | 1537 | usdCsacdCudGauuudAgdAgagcgausasg | 1832 |
| AD-292253.1 | uscsgcucucdTadAaaucaggugaaL96 | 1538 | usdTscadCcdTgauudTadGagagcgasusa | 1833 |
| AD-292254.1 | csgscucucudAadAucaggugaauL96 | 1539 | asdTsucdAcdCugaudTudAgagagcgsasu | 1834 |
| AD-292257.1 | uscsucuaaadTcdAggugaagaaaL96 | 1540 | usdTsucdTudCaccudGadTuuagagasgsc | 1835 |
| AD-292309.1 | asusgcugggdAcdAguauauccauL96 | 1541 | asdTsggdAudAuacudGudCccagcaususa | 1836 |
| AD-292310.1 | usgscugggadCadGuauauccaguL96 | 1542 | adCsugdGadTauacdTgdTcccagcasusu | 1837 |
| AD-292315.1 | gsgsacaguadTadTccagccgauuL96 | 1543 | asdAsucdGgdCuggadTadTacuguccscsa | 1838 |
| AD-292318.1 | csasguauaudCcdAgccgaucuuuL96 | 1544 | asdAsagdAudCggcudGgdAuauacugsusc | 1839 |
| AD-292344.1 | ascscaaggadTgdAagagauuaccaL96 | 1545 | asdGsuadAudCucuudCadTccuuggsusgsc | 1840 |
| AD-292345.1 | cscsaaggaudGadAgagauuaccaL96 | 1546 | usdGsgudAadTcucudTcdAuccuuggsusg | 1841 |
| AD-292346.1 | csasaggaugdAadGagagauuaccaaL96 | 1547 | usdTsggdTadAucucdTudCauccuugsgsu | 1842 |
| AD-292363.1 | cscsaagacadTudTgaggucaacaL96 | 1548 | usdGsuudGadCcucadAadTgucuuggsusa | 1843 |
| AD-292366.1 | asgsacauuudGadGgucaacaucuL96 | 1549 | asdGsaudGudTgaccdTcdAaaugucususg | 1844 |
| AD-292367.1 | gsascauuugdAgdGucaacaucuL96 | 1550 | asdGsgadTgdTugacdCudCaaaugucsusu | 1845 |
| AD-292369.1 | csasuuugagdGudCaacaucccuauL96 | 1551 | asdTsagdGadTguugdAcdCucaaaugsusc | 1846 |
| AD-292370.1 | asusuugaggdTcdAacauccuaguL96 | 1552 | asdCsuadGgdAuguudGadCcucaaausgsu | 1847 |
| AD-292371.1 | ususugaggudCadAcauccuaggaL96 | 1553 | usdCscudAgdGaugudTgdAccucaaasusg | 1848 |
| AD-292373.1 | usgsaggucadAcdAuccuaggacaL96 | 1554 | udGsucdCudAggadGudTgaccucasasa | 1849 |
| AD-292374.1 | gsasggucaadCadTccuaggacauL96 | 1555 | asdTsgudCcdTaggadTgdTugaccucsasa | 1850 |
| AD-292376.1 | gsgsucaacadTcdCuaggacauuuL96 | 1556 | asdAsaudGudCcuagdGadTguugaccsusc | 1851 |
| AD-292377.1 | gsuscaacaudCcdTaggacauuuuL96 | 1557 | asdAsaaTgdTccuadGgdAuguugacscsu | 1852 |
| AD-292379.1 | csasacaucdTadGgacauuuuugL96 | 1558 | csdAsaadAadTguccdTadGgauguusgasc | 1853 |
| AD-292380.1 | asascauccudAgdGacauuuuuguL96 | 1559 | asdCsaadAadAugucdCudAggauguusgsa | 1854 |
| AD-292381.1 | ascsauccuadGgdAcauuuuuggaL96 | 1560 | usdCscadAadAaugudCcdTaggaugususg | 1855 |
| AD-292382.1 | csasuccuagdGadCauuuuuggauL96 | 1561 | asdTsccdAadAaaugdTcdCuaggaugsusu | 1856 |
| AD-292383.1 | asusccuaggdAcdAuuuuuggauuL96 | 1562 | asdAsucdCadAaaaudGudCcuaggausgsu | 1857 |
| AD-292384.1 | uscscuaggadCadTuuuuggaucaL96 | 1563 | usdGsaudCcdAaaaadTgdTccuaggasusg | 1858 |
| AD-292385.1 | cscscuaggacdAudTuuuuggaucauL96 | 1564 | asdTsgadTcdCaaaadAudGuccuaggsasu | 1859 |
| AD-292388.1 | asgsgacauudTudTggaucacaaaL96 | 1565 | usdTsugdTgdAuccadAadAaugcccusasg | 1860 |
| AD-292389.1 | gsgsacauuudTudGgaucacaaaL96 | 1566 | usdTsuudGudGauccdAadAaauguccsusa | 1861 |
| AD-292390.1 | gsascauuuudTgdGaucacaaauL96 | 1567 | asdTsuudTgdTgaucdCadAaaaugucscsu | 1862 |
| AD-292394.1 | ususuuuggadTcdAcaaaagcacuL96 | 1568 | asdGsugdCudTuugudGadTccaaaaasusg | 1863 |
| AD-292397.1 | ususggaucadCadAaagcacucuL96 | 1569 | asdGsaadGudGcuuudTgdTgauccaasasa | 1864 |
| AD-292398.1 | usgsgaucacdAadAagcacuucuuL96 | 1570 | asdAsgadAgdTgcuudTudGugauccasasa | 1865 |
| AD-292399.1 | gsgsaucacadAadAgcacuucuuuL96 | 1571 | asdAsagdAadGugcudTudTgugauccsasa | 1866 |
| AD-292403.1 | csascaaaagdCadCuuucuuccauL96 | 1572 | asdAsugdGadAgaagdTgdCuuuugugsasu | 1867 |
| AD-292404.1 | ascsaaaagcdAcdTucuuccaucuL96 | 1573 | asdGsaudGgdAagaadGudGcuuuugsgsa | 1868 |
| AD-292405.1 | csasaaagcadCudTcuuccaucgaL96 | 1574 | usdCsgadTgdGaagadAgdTgcuuuugsusg | 1869 |
| AD-292406.1 | asasaagcacudTudCuuccaucgauL96 | 1575 | asdTscgdAudGgaagdAadGugcuuususgsu | 1870 |
| AD-292407.1 | asasagcacudTcdTuccaucgauuL96 | 1576 | asdAsucdGadTggaadGadAgugcuuususg | 1871 |
| AD-292408.1 | asasgcacuudCudTccaucgaugaL96 | 1577 | usdCsaudCgdAuggadAgdAagugcuususu | 1872 |
| AD-292409.1 | asgscacuucdTudCcaucgaugauL96 | 1578 | asdTscadTcdGauggdAadGaagugcsusu | 1873 |
| AD-292410.1 | gscscauucudTcdCaucgauguuL96 | 1579 | asdAsucdAudCgaugdGadAgaagugscsusu | 1874 |
| AD-292434.1 | asgsaaaucadTgdGccacaucguuL96 | 1580 | asdAscgdAudGuggcdCadTgauuucuscsu | 1875 |
| AD-292486.1 | ususccuuacdCudCaucccauauuL96 | 1581 | asdAsuadTgdGgaugdAgdGuaaggaasusc | 1876 |
| AD-292487.1 | uscscuuaccdTcdAucccauauuuL96 | 1582 | asdAsaudAudGggaudGadGguaaggsasasu | 1877 |
| AD-292492.1 | ascscucaucdCcdAuauuguuccaL96 | 1583 | usdGsgadAcdAauaudGdGauuauagagusasa | 1878 |
| AD-292495.1 | uscsaucccadTadTguuccagcaL96 | 1584 | udGscudGgdAacaadTadTgggaugasgsg | 1879 |
| AD-292498.1 | uscscauaudTgdTuccagcaaauL96 | 1585 | asdTsuudGcdTggaadCadAuauggasusg | 1880 |
| AD-292499.1 | cscscauauudGudTccagcaaauuL96 | 1586 | asdAsuudTgdCuggadAcdAauaugggsasu | 1881 |
| AD-292526.1 | usgsuuggcudTudCacagagsgucuL96 | 1587 | asdGsacdCudCugugdAadAgccaacasgsc | 1882 |
| AD-292531.1 | gscsuuucacdAgdAggucugacauL96 | 1588 | asdTsgudCadGaccudCudGugaaagcscsa | 1883 |
| AD-292534.1 | ususcacagadGgdTcugacaucauL96 | 1589 | asdTsgadTgdTcagadCcdTcugugaasasg | 1884 |
| AD-292536.1 | csascagaggdTcdTgacaucagaaL96 | 1590 | udTscudGadTgucadGadCcucugugsasa | 1885 |
| AD-292541.1 | asgsgucugadCadTcagaacucaL96 | 1591 | usdGsaadGudTcugadTgdTcagaccuscsu | 1886 |
| AD-292566.1 | ususggggaaadAadCugguaucaaaL96 | 1592 | udTsugdAudAccagdTudTuucccaasgsg | 1887 |
| AD-292574.1 | asascugguadTcdAaaaccucauuL96 | 1593 | asdAsugdAgdGuuuudGadTaccaguususu | 1888 |
| AD-292575.1 | ascscuguaudCadAaaaccucauguL96 | 1594 | asdCsaudGadGguuudTgdAuaccagsusu | 1889 |
| AD-292576.1 | csusgguaucdAadAaaccucauguL96 | 1595 | asdAscadTgdAgguudTudGauaccagsusu | 1890 |
| AD-292577.1 | usgsguaucadAadAccucauguccL96 | 1596 | asdGsacdAdGaggudTdTgauaccasgsu | 1891 |
| AD-292578.1 | gsgsuaucaadAadCcucaugucuuL96 | 1597 | asdAsgcdAdTgaggdTudTugauaccsasg | 1892 |
| AD-292579.1 | gsusaucaaadAcdCucaugucucuL96 | 1598 | asdGsagdAcdAugagdGudTuugauacscsa | 1893 |
| AD-292582.1 | uscsaaaaccdTcdAugucucugcuL96 | 1599 | asdGscadGadGacaudGadGguuuugasusa | 1894 |
| AD-292596.1 | csuscugcccdAgdTuuuugugaauL96 | 1600 | asdTsucdAcdAaaaadCudGggcagagsasu | 1895 |
| AD-292601.1 | cscscaguuudTudGugaauacuguL96 | 1601 | asdCsagdTadTucacdAadAaacugggcssa | 1896 |
| AD-292606.1 | ususuuugugdAadTacugggcauuL96 | 1602 | usdGsaadCcdCaguadTudCacaaaascsu | 1897 |
| AD-292607.1 | ususuugugadAudAcugggucauL96 | 1603 | asdTsgadAcdCcagudAudTcacaaaasc | 1898 |
| AD-292610.1 | usgsgaauadCudGgguucaccaaL96 | 1604 | udTsggdTgdAacccdAgdTauucacaasgs | 1899 |
| AD-292612.1 | usgsaauacudGgdGguucaccaaaL96 | 1605 | usdTsuudGgdTgaacdCcdAguauucasca | 1900 |
| AD-292613.1 | gsasauacugdGgdTucaccaaaaL96 | 1606 | usdTsuudGdTgaadCcdCaguauucssac | 1901 |
| AD-292614.1 | asasuacuggdGudTcaccaaaaaL96 | 1607 | asdTsuudTdTgguagadAcdCcaguauuscsa | 1902 |
| AD-292615.1 | asusacugggdTudTcaccaaaaauL96 | 1608 | asdAsuudTdTggugdAadCccaguaususcc | 1903 |
| AD-292616.1 | usascugggudTcdAccaaaaaucuL96 | 1609 | asdGsaudTdTuggudGadAcccaguasusu | 1904 |

TABLE 10-continued

HSD17B13 NonF DNA Modified Sequence*

| | | | | | | |
|---|---|---|---|---|---|---|
| AD-292624.1 | uscsaccaaadAadTccaagcacaaL96 | 1610 | | usdTsgudGcdTuggadTudTuuggugasasc | 1905 |
| AD-292625.1 | csasccaaaadAudCcaagcacaauL96 | 1611 | | asdTsugdTgdCuuggdAudTuuuggugsasa | 1906 |
| AD-292629.1 | asasaaauccdAadGcacaagauuaL96 | 1612 | | usdAsaudCudTgugcdTudGgauuuusgsg | 1907 |
| AD-292630.1 | asasaauccadAgdCacaagauuauL96 | 1613 | | asdTsaadTcdTugugdCudTggauuuususg | 1908 |
| AD-292631.1 | asasauccaadGcdAcaagauuauuL96 | 1614 | | asdAsuadAudCuugudGcdTggauuususu | 1909 |
| AD-292634.1 | uscscaagcadCadAgauuauggcuL96 | 1615 | | asdGsccdAudAaucudTgdTgcuuggasusu | 1910 |
| AD-292638.1 | asgscacaagdAudTauggccuguaL96 | 1616 | | usdAscadGgdCcauadAudCuugugcsusug | 1911 |
| AD-292639.1 | gscscacaagadTudAuggccuguauL96 | 1617 | | asdTsacdAgdGccaudAadTcuugugcsusu | 1912 |
| AD-292640.1 | csascaagaudTadTggccuguauuL96 | 1618 | | asdAsuadCadGgccadTadAucuugugscsu | 1913 |
| AD-292641.1 | ascsaagauudAudGgccuguauuuL96 | 1619 | | asdAsaudAcdAggccdAudAaucuugsgsc | 1914 |
| AD-292642.1 | csasagauuadTgdGccuguauuguL96 | 1620 | | asdCsaadTadCaggcdCadTaaucuugsusg | 1915 |
| AD-292646.1 | asusuauggcdCudGuauuggagauL96 | 1621 | | asdTscudCcdAauacdAgdGccauaauscsu | 1916 |
| AD-292650.1 | usgsgccugudAudTggagacagauL96 | 1622 | | asdTscudGudCuccadAudAcaggccasusa | 1917 |
| AD-292651.1 | gsgsccuguadTudGgagacagauuL96 | 1623 | | asdAsucdTgdTcuccdAadTacaggccsasu | 1918 |
| AD-292652.1 | gscscuguaudTgdGagacagaugaL96 | 1624 | | usdCsaudCudGucucdCadAuacaggcscsa | 1919 |
| AD-292667.1 | asgsaugaagdTcdGuaagaagucuL96 | 1625 | | asdGsacdTudCuuacdGadCuucaucusgsu | 1920 |
| AD-292668.1 | gsasugaagudCgdTaagaagucuuL96 | 1626 | | asdAsgadCudTcuuadCgdAcuucaucsusg | 1921 |
| AD-292671.1 | gsasaguegudAadGaagucugauaL96 | 1627 | | usdAsucdAgdAcuucdTudAcgacuucsasu | 1922 |
| AD-292673.1 | asgsucguaadGadAgucugauagaL96 | 1628 | | usdCsuadTcdAgacudTcdTuacgacususc | 1923 |
| AD-292677.1 | gsusaagaagdTcdTgauagauggaL96 | 1629 | | usdCscadTcdTaucadGadCuucuuacsgsa | 1924 |
| AD-292678.1 | usasagaagudCudGauagauggaaL96 | 1630 | | usdTsccdAudCuuacdAgdAcucuuascsg | 1925 |
| AD-292679.1 | asasgaagucdTgdAuagauggaauL96 | 1631 | | asdTsucdCadTcuaudCadGacuucuusasc | 1926 |
| AD-292680.1 | asgsaugucudGadTagauggaauaL96 | 1632 | | usdAsuudCcdAucuadTcdAgacucususa | 1927 |
| AD-292681.1 | gsasagucugdAudAgauggaauauL96 | 1633 | | asdTsaudTcdCaucudAudCagacuucsusu | 1928 |
| AD-292682.1 | asasgucugadTadGauggaauacuL96 | 1634 | | asdGsuadTudCcaucdTadTcagacuuscsu | 1929 |
| AD-292684.1 | gsuscugauadGadTggaauacuaaL96 | 1635 | | usdAsagdTadTuccadTcdTaucagacsusu | 1930 |
| AD-292685.1 | uscsuagaugdAudGgaauacuuauL96 | 1636 | | asdTsaadGudAuuccdAudCuaucagascsu | 1931 |
| AD-292691.1 | asgsauggaadTadCuuaccaauaaL96 | 1637 | | usdTsaudTgdGuaagdTadTuccaucusasu | 1932 |
| AD-292692.1 | gsasuggaaudAcdTuaccaauaauL96 | 1638 | | asdTsuadTudGguaadGudAuuccaucsusa | 1933 |
| AD-292693.1 | asusggaauadCudTaccaauaagaL96 | 1639 | | usdCsuudAudTgguadAgdTauuccauscsu | 1934 |
| AD-292694.1 | usgsgaauacdTudAccaauaagaaL96 | 1640 | | usdTscudTadTuggudAadGuauuccasasu | 1935 |
| AD-292695.1 | gsgsaauacudTadCcaauaagaaaL96 | 1641 | | usdTsucdTudAauggdTadAguauuccsasu | 1936 |
| AD-292696.1 | gsasauacuudAcdCaauaagaaaaL96 | 1642 | | usdTsuudCudTauugdGudAaguauuccsca | 1937 |
| AD-292697.1 | asasuacuuadCcdAauaagaaaauL96 | 1643 | | asdTsuudTcdTuauudGgdTaaguauuscsc | 1938 |
| AD-292725.1 | gsusuccaucdGudAuaucaauauuL96 | 1644 | | asdAsuadTudGauaudAcdGauggaacsasa | 1939 |
| AD-292726.1 | ususccaucgdTadTaucaauaucuL96 | 1645 | | asdGsaudAudTgauadTadCgauggaascsa | 1940 |
| AD-292727.1 | uscscaucgudAudAucaauaucuuL96 | 1646 | | asdAsgadTadTugaudAudAcgauggasasc | 1941 |
| AD-292728.1 | cscscaucguadTadTcaauaucuuuL96 | 1647 | | asdAsagdAudAuugadTadTacgauggsasa | 1942 |
| AD-292757.1 | ascsagaagudTudCuuccgaacuL96 | 1648 | | asdGsuudCadGgaagdAadAcuucugusasg | 1943 |
| AD-292759.1 | asgsaaguuudCudTccugaacgcuL96 | 1649 | | asdGscgdTudCaggadAgdAaacuucusgsu | 1944 |
| AD-292761.1 | asasguuucudTcdCugaacgcgcuL96 | 1650 | | asdGscgdCgdTucagdGadAgaaacuuscsu | 1945 |
| AD-292766.1 | uscsuuccugdAadCgcgccucaguL96 | 1651 | | asdCsugdAgdGcgcgdTudCaggaagasasa | 1946 |
| AD-292787.1 | gsasuuuuaadAudCguaugcagaaL96 | 1652 | | usdTscudGcdAuacgdAudTuaaaaucsgsc | 1947 |
| AD-292788.1 | asusuuuaaadTcdGuaugcagaauL96 | 1653 | | asdTsucdTgdCauacdGadTuuaaaauscsg | 1948 |
| AD-292789.1 | ususuuaaaudCgdTaugcagaauaL96 | 1654 | | usdAsuudCudGcauadCgdAuuuaaaasusc | 1949 |
| AD-292793.1 | asasaucguadTgdCagaauauucaL96 | 1655 | | usdGsaadTadTucugdCadTacgauuusasa | 1950 |
| AD-292795.1 | asuscguaugdCadGaauauucaauL96 | 1656 | | asdTsugdAadTauucdTgdCauacgaususu | 1951 |
| AD-292796.1 | uscsguaugcdAgdAauauucaauuL96 | 1657 | | asdAsuudGadAuauudCudGcauacgasusu | 1952 |
| AD-292797.1 | csgsuaugcadGadAuauucaauuuL96 | 1658 | | asdAsaudTgdAauaudTcdTgcauacgsasu | 1953 |
| AD-292800.1 | asusgcagaadTadTucaauuugaaL96 | 1659 | | usdTscadAadTugaadTadTucugcausasc | 1954 |
| AD-292802.1 | gscscagaauadTudCaauuugaaguL96 | 1660 | | asdCsuudCadAauugdAadTauucugcsasu | 1955 |
| AD-292806.1 | asasauuucadAudTugaagcaguuL96 | 1661 | | asdAscudGcdTucaadAudTgaauauuscsu | 1956 |
| AD-292808.1 | usasuucaaudTudGaagcaguggL96 | 1662 | | asdCscadCudGcuucdAadAuugaauasusu | 1957 |
| AD-292870.1 | gsasuguaugdCadTgauaaugauaL96 | 1663 | | usdAsucdAudTaucadTgdCauacaucsusc | 1958 |
| AD-292893.1 | asasuaguuudCgdAaucaaugcuuL96 | 1664 | | asdAsgcdAudTgauudCgdAaacuauuscsa | 1959 |
| AD-292906.1 | csasaugcugdCadAagcuuuauuuL96 | 1665 | | asdAsaudAadAgcuudTgdCagcauugsasu | 1960 |
| AD-292915.1 | asasagcuuudAudTucacauuuuuL96 | 1666 | | asdAsaadAudGugaadAudAaagcuuusgsc | 1961 |
| AD-292935.1 | asasaaacaudTgdGuuuggcacuaL96 | 1667 | | usdAsgudGcdCaaacdCadAuguuuusasa | 1962 |
| AD-292936.1 | asasaacauudGgdTuuggcacuauL96 | 1668 | | asdTsagdTgdCcaaadCcdAauguuuusua | 1963 |
| AD-292967.1 | ascsgaacaadGadTuaauuaccuuL96 | 1669 | | asdAsggdTadAuuaadTcdTuguucgususu | 1964 |
| AD-292970.1 | ascscaagaudTadAuuaccugucuL96 | 1670 | | asdCsagdAgdGuaaudTadAucuuguuscsg | 1965 |
| AD-292974.1 | asgsauuaaudTadCcugucuuccuL96 | 1671 | | asdGsadAgdAcaggdTadAuuaaucususg | 1966 |
| AD-292975.1 | gsasuuaauudAcdCugucuuccuuL96 | 1672 | | asdAsggdAadGacagdGudAauuaaucsusu | 1967 |
| AD-292978.1 | usasauuaccdTgdTcuuccuguuuL96 | 1673 | | asdAsacdAgdGaagadCadGguaauuasasu | 1968 |
| AD-292979.1 | asasuuaccudGudCuuccuguuucL96 | 1674 | | gsdAsaadGaagdAcdAgguaauusasa | 1969 |
| AD-292980.1 | asusuaccugdTcdTuccuguuucuL96 | 1675 | | asdGsaadAcdAggaadGadCagguaaususa | 1970 |
| AD-292981.1 | ususaccugudCudTccuguuucuuL96 | 1676 | | asdAsgadAadCaggadAgdAcagguasusu | 1971 |
| AD-292982.1 | usasccugucdTudCcuguuucucaL96 | 1677 | | usdGsagdAadAcaggdAadGacagguasasu | 1972 |
| AD-292983.1 | ascscugucudTcdCuguuucucaaL96 | 1678 | | usdTsgadAacagdGadAgacagguasasa | 1973 |
| AD-292984.1 | cscsugucuudCcdTguuucucaauL96 | 1679 | | asdTsugdAgdAaacadGgdAagacaggsusa | 1974 |
| AD-293027.1 | gsgsucuguuudTudTccuuucauguL96 | 1680 | | asdCsaudGadAaggadAadAacagaccsusa | 1975 |
| AD-293028.1 | gsuscuguuudTudCcuuucaugcuL96 | 1681 | | asdGscadTgdAaaggdAadAaacagascsu | 1976 |
| AD-293034.1 | ususuuccuudTcdAugccucuuaaL96 | 1682 | | usdTsaadGadGgcaudGadAaggaaaasasc | 1977 |
| AD-293037.1 | uscscuuucadTgdCcucuuaaaaL96 | 1683 | | usdTsuudTadAgaggdCadTgaaaggasasa | 1978 |
| AD-293039.1 | csususucaugdCcdTcuuaaaaacuL96 | 1684 | | asdGsuudTudTaagadGgdCaugaaaggsgsa | 1979 |
| AD-293099.1 | ususuuuuccadTudTaaagguggauL96 | 1685 | | asdTsccdAcdCuuuadAadTggaaaaasusa | 1980 |
| AD-293153.1 | asascuuauudTadCacagggaaguL96 | 1686 | | asdCsuudCcdCugugdTadAauaaguuscsu | 1981 |
| AD-293156.1 | ususuauuuacdAcdAggggaaguuuL96 | 1687 | | asdAsacdCudTccudGudGuaaauaasgsu | 1982 |

TABLE 10-continued

HSD17B13 NonF DNA Modified Sequence*

| | | | | |
|---|---|---|---|---|
| AD-293162.1 | ascsacagggdAadGguuuaagacuuL96 | 1688 | asdGsucdTudAaaccdTudCccugugusasa | 1983 |
| AD-293163.1 | csascagggadAgdGuuuaagacuuL96 | 1689 | asdAsgudCudTaaacdCudTcccugugsusa | 1984 |
| AD-293166.1 | asgsgbaaggdTudTaagacuguuuL96 | 1690 | asdAsacdAgdTcuuadAadCcuucccusgsu | 1985 |
| AD-293167.1 | gsgsgaaggudTudTAagacguucaL96 | 1691 | usdGsaadCadGucuudAadAccuucccsusg | 1986 |
| AD-293168.1 | gsgsaagguudTudTAgacuguucaaL96 | 1692 | usdTsgadAcdAgucudTadAaccuuccscsu | 1987 |
| AD-293169.1 | gsasaagguuudAadGacuguucaauL96 | 1693 | asdTsugdAadCagucdTudAaaccuucscsc | 1988 |
| AD-293170.1 | asasgguuuadAgdAcuguucaaguL96 | 1694 | asdCsuudGadAcagudCudTaaaccuuscsc | 1989 |
| AD-293171.1 | asgsguuuaadGadCuguucaaguaL96 | 1695 | usdAscudTgdAacagdTcdTuaaaccususc | 1990 |
| AD-293172.1 | gsgsguuuaagdAcdTguucaaguauL96 | 1696 | asdTsacdTudGaacadGudCuuaaaccsusu | 1991 |
| AD-293174.1 | ususuaagacdTgdTucaaguagcaL96 | 1697 | usdGscudAcdTugaadCadGucuuaaascsc | 1992 |
| AD-293176.1 | usasagacugdTudCaaguagcauuL96 | 1698 | asdAsugdCudAcuugdAadCagucuuasasa | 1993 |
| AD-293177.1 | asasgacugudTcdAaguagcauuuL96 | 1699 | asdAsaudGcdTacuudGadAcagucuusasa | 1994 |
| AD-293178.1 | asgsacuguudCadAguagcauucuL96 | 1700 | asdGsaadTgdCuacudTgdAacagucususa | 1995 |
| AD-293179.1 | gsascuguuucdAadGuagcauuccaL96 | 1701 | usdGsgadAudGcuacdTudGaacagucsusu | 1996 |
| AD-293180.1 | ascsuguuucadAgdTagcauuccaaL96 | 1702 | usdTsggdAadTgcuadCudTgaacaguscsu | 1997 |
| AD-293181.1 | csusguuucaadGudAgcauuccaauL96 | 1703 | asdTsugdGadAugcudAcdTgaacagsusc | 1998 |
| AD-293182.1 | usgsuucaagdTadGcauuccaauuL96 | 1704 | asdAsuudGgdAaugcdTadCuugaacasgsu | 1999 |
| AD-293183.1 | gsusucaagudAgdCauuccaaucuL96 | 1705 | asdGsaudTgdGaaugdCudAcuugaacsasg | 2000 |
| AD-293184.1 | ususucaaguadGcdAuuccaaucuuL96 | 1706 | asdAsgadTudGgaaudGcdTacuugaascsa | 2001 |
| AD-293186.1 | csasaguagcdAudTccaaucuguaL96 | 1707 | usdAscadGadTuggadAudGcuacuugsasa | 2002 |
| AD-293187.1 | asasguagcadTudTccaaucuguauL96 | 1708 | asdTsacdAgdAuuggdAadTgcuacuusgsa | 2003 |
| AD-293191.1 | asgscauuccdAadTcuguagccauL96 | 1709 | asdTsggdCudAcagadTudGgaaugcusasc | 2004 |
| AD-293218.1 | gsasauaucdAcdAagaacacagaL96 | 1710 | usdCsugdTgdTucuudGudTgauauucsusg | 2005 |
| AD-293228.1 | asasgaacacdAgdAaugagugcauL96 | 1711 | asdTsgcdAcdTcauudCudGuguucuusgsu | 2006 |
| AD-293230.1 | gsasacacagdAadTgagugcacauL96 | 1712 | asdTsgudGcdAcucadTudCuguguucsusu | 2007 |
| AD-293231.1 | asascacagadAudGagugcacaguL96 | 1713 | asdCsugdTgdCacucdAudTcuguguuscsu | 2008 |
| AD-293235.1 | csasgaaugadGudGcacagcuaauL96 | 1714 | adTsuadGcdTgugcdAcdTcauucsgusg | 2009 |
| AD-293271.1 | asgsgcagcudTudAucucaaccuuL96 | 1715 | asdAsggdTudGagaudAadAgcugccusgsc | 2010 |
| AD-293273.1 | gscsagcuuudAudCucaaccuggaL96 | 1716 | usdCscadGgdTugagdAudAaagcugcscsu | 2011 |
| AD-293306.1 | ususcagcaudTudGaaagauuucuL96 | 1717 | asdGsaadAudCuuucdAadAugcugaasusc | 2012 |
| AD-293309.1 | asgscauuugdAadAgauuucccuaL96 | 1718 | usdAsggdGadAaucudTudCaaaugcusgsa | 2013 |
| AD-293311.1 | csasuuuugaadAgdAuuucccuaguL96 | 1719 | asdCsuadGgdGaaaudCudTucaaugscsu | 2014 |
| AD-293312.1 | asusuugaaadGadTuucccuagcuL96 | 1720 | asdGscudAgdGgaaadTcdTuucaausgsc | 2015 |
| AD-293315.1 | usgsaaagaudTudCcccuagccucuL96 | 1721 | asdGsagdGcdTagggdAadAucuuucasasa | 2016 |
| AD-293316.1 | gsasaagauudTcdCcuagccucuuL96 | 1722 | asdAsgadGgdCuaggdGadAaucuuucsasa | 2017 |
| AD-293323.1 | ususcccuagdCcdTcuuccuuuuuL96 | 1723 | asdAsgdGaagadGgdCuagggaasasu | 2018 |
| AD-293353.1 | asasaacggudGcdAacucuauucuL96 | 1724 | asdGsaadTadGaguudGcdAccguuusgsg | 2019 |
| AD-293354.1 | asasacggugdCadAcucuauucuuL96 | 1725 | asdAsgadAudAgagudTgdCaccguuusugs | 2020 |
| AD-293355.1 | asascggugcdAadCucuauucguL96 | 1726 | asdCsagadAadTagagdTudGcaccguususu | 2021 |
| AD-293358.1 | gsgsugcaacdTcdTauucuggacuL96 | 1727 | asdGsucdCadGaauadGadGuugcacesgsu | 2022 |
| AD-293359.1 | gsusgcaacudCudAuucuggacuuL96 | 1728 | asdAsgudCcdAgaaudAgdAguugcacscsg | 2023 |
| AD-293360.1 | usgscaacucdTadTucuggacuuuL96 | 1729 | asdAsagdTcdCagaadTadGaguugcascsc | 2024 |
| AD-293361.1 | gscsaacucudAudTcuggacuuuaL96 | 1730 | usdAsaadGudCcagadAudAgaguugcsasc | 2025 |
| AD-293362.1 | csasacucuadTudCuggacuuuauL96 | 1731 | asdTsaadAgdTccagdAdTagaguugscsa | 2026 |
| AD-293363.1 | asascucuaudTcdTggacuuuauuL96 | 1732 | asdAsuadAadGuccadGadAuagaguusgsc | 2027 |
| AD-293364.1 | ascsucuauudCudGgacuuuauuaL96 | 1733 | usdAsaudAadAguccdAgdAauagagususg | 2028 |
| AD-293365.1 | csuscuauucdTgdGacuuuauuauL96 | 1734 | asdTsaadTadAagucdCadGaauagagsusu | 2029 |
| AD-293368.1 | usasuucuggdAcdTuuauuacuuuL96 | 1735 | asdAsgadTadAuaaadGudCcagaauasgsa | 2030 |
| AD-293369.1 | asusucuggadCudTuauuacuugaL96 | 1736 | usdCsaadGudAauaadAgdTccagaausasg | 2031 |
| AD-293370.1 | ususcuggacdTudTauuacuugauL96 | 1737 | asdTscadAgdTaauadAadGuccagaasusa | 2032 |
| AD-293410.1 | usgsaaguccdAcdCaaaagggauL96 | 1738 | asdTscdAcdTuuugdGudGgacuucasgsa | 2033 |
| AD-293419.1 | cscsaaaagudGgdAccccucuauauL96 | 1739 | asdTsaudAgdAgggudCcdAcuuuuggsusg | 2034 |
| AD-293420.1 | csasaaagugdGadCcccucuauauuL96 | 1740 | asdAsuadTadGagggdTcdCacuuuugsgsu | 2035 |
| AD-293422.1 | asasaguggadCcdCucuauauuucL96 | 1741 | gsdAsaadTadTagagdGgdTccacuuususg | 2036 |
| AD-293423.1 | asasguggacdCcdTcuauauuucuL96 | 1742 | asdGsaadAudAuagadGgdGuccacuususu | 2037 |
| AD-293530.1 | csusuucauadTadTccuuggccuL96 | 1743 | asdGsgadCcdAaggadTadTaugaaagscsa | 2038 |
| AD-293532.1 | ususcauauadTcdCuuggucccauL96 | 1744 | asdTsggdGadCcaagdGadTauaugaasasg | 2039 |
| AD-293554.1 | gsasuguuuadGadCaauuuuaggcuL96 | 1745 | asdCscudAadAauugdTcdTaaacaucsusc | 2040 |
| AD-293555.1 | asusguuuagdAcdAauuuuaggcuL96 | 1746 | asdGsccdTadAaauudGudCuaaacauscsu | 2041 |
| AD-293557.1 | gsusuuagacdAadTuuuaggcucaL96 | 1747 | usdGsagdCcdTaaaadTudGucuaaacsasu | 2042 |
| AD-293558.1 | ususuagacadAdTuuaggcucaaL96 | 1748 | asdTsgadGcdCuaaadAudTgucuaaascsa | 2043 |
| AD-293559.1 | ususagacaadTudTaaggcucaaaL96 | 1749 | usdTsgdAgdCcuaadAadTugcuaasasc | 2044 |
| AD-293560.1 | usasgacaaudTudTaggcucaaaaL96 | 1750 | usdTsuudGadGccuadAadAuugcuasasa | 2045 |
| AD-293562.1 | gsascaauuudTadGgcucaaaauL96 | 1751 | asdTsuudTudGagccdTadAaauugcsusa | 2046 |
| AD-293569.1 | ususaggcucdAadAauuaaagcuuL96 | 1752 | asdGscudTudAauuudTudGagccuaasasa | 2047 |
| AD-293570.1 | usasggcucadAadAauuaaagcuaL96 | 1753 | usdAsgcdTudTaauudTudTgagccuasasa | 2048 |
| AD-293571.1 | asgsgcucaadAadAuuaaagcuaaL96 | 1754 | usdTsagdCudTuaaudTudTugagccusasa | 2049 |
| AD-293572.1 | gsgsgcucaadAdTuaaagcuaauL96 | 1755 | asdTsuadGcdTuuaadTudTuugagccsusa | 2050 |
| AD-293573.1 | gscsucaaaadAudTaaagcuaacaL96 | 1756 | usdGsuudAgdCuuuaadAudTuuugagcscsu | 2051 |
| AD-293574.1 | csuscaaaaadTudAaagcuaacauL96 | 1757 | asdTsgudTadGcuuudAadTuuuugagscsc | 2052 |
| AD-293575.1 | uscsaaaaudTadAagcuaacacaL96 | 1758 | usdGsugdTudAgcuudTadAuuuuugasgsc | 2053 |
| AD-293576.1 | csasaaaauudAadAgcuaacacauL96 | 1759 | asdTsgudGudTagcudTudAauuuugsasg | 2054 |
| AD-293579.1 | asasauaaadGcdTaacacaggaaL96 | 1760 | usdTscdTgdTguuadGcdTuuaauuususu | 2055 |
| AD-293586.1 | asgscuaacadCdGgaaaaggaauL96 | 1761 | asdTsucdCudTuucedTgdTguuagcususu | 2056 |
| AD-293589.1 | usasacacagdCdAaggaacuguL96 | 1762 | asdCsagdTudCcuuudTcdCuguguuasgsc | 2057 |
| AD-293592.1 | csascaggaadAadGgaacguacuL96 | 1763 | asdGsuadCadGuuccdTudTccugugsusu | 2058 |
| AD-293594.1 | csasggaaaadGgdAacuguacuL96 | 1764 | asdCsagdTadCaguudCedTuuccgsusg | 2059 |
| AD-293601.1 | asgsgaacugdTadCuggcuauuauL96 | 1765 | asdTsaadTadGccagdTadCaguuccususu | 2060 |

TABLE 10-continued

HSD17B13 NonF DNA Modified Sequence*

| | | | | |
|---|---|---|---|---|
| AD-293602.1 | gsgsaacugudAcdTggcuauuacaL96 | 1766 | usdGsuadAudAgccadGudAcaguuccsusu | 2061 |
| AD-293872.1 | csgsacucccdAcdTacaucaagauL96 | 1767 | asdTscudTgdAuguadGudGggagucgsgsa | 2062 |
| AD-293875.1 | csusccacudAcdAucaagacuaaL96 | 1768 | usdTsagdTcdTugaudGudAgugggagsusc | 2063 |
| AD-293876.1 | uscsccacuadCadTcaagacuaauL96 | 1769 | asdTsuadGudCuugadTgdTaguggggasgsu | 2064 |
| AD-293877.1 | cscscacuacdAudCaagacuaauuL96 | 1770 | asdAsuudAgdTcuugdAudGuagugggasag | 2065 |
| AD-293878.1 | cscsacuacadTcdAagacuaaucuL96 | 1771 | asdGsaudTadGucuudGadTguaguggsgsa | 2066 |
| AD-293879.1 | csascuacaudCadAgacuaaucuaL96 | 1772 | asdAsgadTudAgucudTgdAuguaguggsga | 2067 |
| AD-293880.1 | ascsuacaucdAadGacuaaucuuuL96 | 1773 | asdAsagdAudTagucdTudGauguagusgsg | 2068 |
| AD-293881.1 | csusacaucadAgdAcuaaucuuguL96 | 1774 | asdCsaadGadTuagudCudTgauguagsusg | 2069 |
| AD-293882.1 | usascaucaadGadCuaaucuuguuL96 | 1775 | asdAscadAgdAuuagdTcdTugauguasgsu | 2070 |
| AD-293883.1 | ascsaucaagdAcdTaaucuuguuuL96 | 1776 | asdAsacdAadGauuadGudCuugaugusasg | 2071 |
| AD-293898.1 | ususgugugudTudTucacauguauL96 | 1777 | asdTsacdAudGugaadAadAcacacaasasa | 2072 |
| AD-293902.1 | gsusguuuudCadCauguauuauaL96 | 1778 | usdAsuadAudAcaugdTgdAaaaacacsasc | 2073 |
| AD-293909.1 | uscsacaugudAudTauagaaugcuL96 | 1779 | asdGscadTudCuauadAudAcaugugasasa | 2074 |
| AD-293910.1 | csascauguadTudAuagaaugcuuL96 | 1780 | asdAsgcdAudTcuaudAadTacaugugsasa | 2075 |
| AD-293914.1 | usgsuauuaudAgdAaugcuuuuguL96 | 1781 | asdCsaadAadGcauudCudAuaauacasusg | 2076 |
| AD-293915.1 | gsusauuauadGadAugcuuuugcaL96 | 1782 | usdGscadAadAgcaudTcdTauaauacsasu | 2077 |
| AD-293919.1 | usasuagaaudGcdTuuugcauggaL96 | 1783 | usdCscadTgdCaaaadGcdAuucuauasasu | 2078 |
| AD-293922.1 | asgsaaugcudTudTgcauggacuaL96 | 1784 | usdAsgudCcdAugcadAadAgcauucusasu | 2079 |
| AD-293923.1 | gsasaugcuudTudGcauggacuauL96 | 1785 | asdTsagdTcdCaugcdAadAagcauucsusa | 2080 |
| AD-293925.1 | asusgcuuuudGcdAuggacuaucuL96 | 1786 | asdGsaudAgdTccaudGcdAaaagcaususc | 2081 |
| AD-293928.1 | csusuuugcadTgdGacuauccucuL96 | 1787 | asdGsagdGadTagucdCadTgcaaaagscsa | 2082 |
| AD-293931.1 | ususgcauggdAcdTauccucuuguL96 | 1788 | asdCsaadGadGgauadGudCcaugcaasasa | 2083 |
| AD-293932.1 | usgscauggadCudAuccucuuguuL96 | 1789 | asdAscadAgdAggaudAgdTccaugcasasa | 2084 |
| AD-293933.1 | gscsauggacdTadTccucuuguuuL96 | 1790 | asdAsacdAadGaggadTadGuccaugcsasa | 2085 |
| AD-293934.1 | csasuggacudAudCcucuuguuuuL96 | 1791 | asdAsaadCadAgaggdAudAguccaugscsa | 2086 |
| AD-293935.1 | asuggacuadTcdCucuuguuuuuL96 | 1792 | asdAsacdAcdAagagdGadTaguccausgsc | 2087 |
| AD-293936.1 | usgsgacuaudCcdTcuuguuuuuaL96 | 1793 | usdAsaadAadCaagadGgdAuaguccasusg | 2088 |
| AD-293937.1 | gsgsacuaucdCudCuuguuuuuaaL96 | 1794 | asdTsaadAadAcaagdAgdGauaguccsasu | 2089 |
| AD-293938.1 | gsascuauccdTcdTuguuuuauuL96 | 1795 | asdAsuadAadAacaadGadGgauagucscsa | 2090 |
| AD-293940.1 | csusauccucdTudGuuuuauuaaL96 | 1796 | usdTsaadTadAaaacdAadGaggauagsusc | 2091 |

| Duplex Name | mRNA target sequence 5' to 3' | SEQ ID NO: |
|---|---|---|
| AD-291929.1 | CUACACAAGGACUGAACCAGAAG | 2092 |
| AD-291931.1 | ACACAAGGACUGAACCAGAAGGA | 2093 |
| AD-291988.1 | AAUCCUUCUGCUUCUGAUCACCA | 2094 |
| AD-291993.1 | UUCUGCUUCUGAUCACCAUCAUC | 2095 |
| AD-291998.1 | CUUCUGAUCACCAUCAUCUACUC | 2096 |
| AD-292005.1 | UCACCAUCAUCUACUCCUACUUG | 2097 |
| AD-292006.1 | CACCAUCAUCUACUCCUACUUGG | 2098 |
| AD-292007.1 | ACCAUCAUCUACUCCUACUUGGA | 2099 |
| AD-292008.1 | CCAUCAUCUACUCCUACUUGGAG | 2100 |
| AD-292010.1 | AUCAUCUACUCCUACUUGGAGUC | 2101 |
| AD-292012.1 | CAUCUACUCCUACUUGGAGUCGU | 2102 |
| AD-292013.1 | AUCUACUCCUACUUGGAGUCGUU | 2103 |
| AD-292014.1 | UCUACUCCUACUUGGAGUCGUUG | 2104 |
| AD-292015.1 | CUACUCCUACUUGGAGUCGUUGG | 2105 |
| AD-292016.1 | UACUCCUACUUGGAGUCGUUGGU | 2106 |
| AD-292017.1 | ACUCCUACUUGGAGUCGUUGGUG | 2107 |
| AD-292028.1 | GAGUCGUUGGUGAAGUUUUUCAU | 2108 |
| AD-292137.1 | UAUUGGUUCUGUGGGAUAUUAAU | 2109 |
| AD-292140.1 | UGGUUCUGUGGGAUAUUAAUAAG | 2110 |
| AD-292143.1 | UUCUGUGGGAUAUUAAUAAGCGC | 2111 |
| AD-292182.1 | CAGCUGAGUGCCGAAAACUAGGC | 2112 |
| AD-292183.1 | AGCUGAGUGCCGAAAACUAGGCG | 2113 |
| AD-292185.1 | CUGAGUGCCGAAAACUAGGCGUC | 2114 |
| AD-292186.1 | UGAGUGCCGAAAACUAGGCGUCA | 2115 |
| AD-292187.1 | GAGUGCCGAAAACUAGGCGUCAC | 2116 |
| AD-292188.1 | AGUGCCGAAAACUAGGCGUCACU | 2117 |
| AD-292189.1 | GUGCCGAAAACUAGGCGUCACUG | 2118 |
| AD-292190.1 | UGCCGAAAACUAGGCGUCACUGC | 2119 |
| AD-292238.1 | AACAGAGAAGAGAUCUAUCGCUC | 2120 |
| AD-292244.1 | GAAGAGAUCUAUCGCUCUCUAAA | 2121 |
| AD-292245.1 | AAGAGAUCUAUCGCUCUCUAAAU | 2122 |
| AD-292247.1 | GAGAUCUAUCGCUCUCUAAAUCA | 2123 |
| AD-292248.1 | AGAUCUAUCGCUCUCUAAAUCAG | 2124 |
| AD-292250.1 | AUCUAUCGCUCUCUAAAUCAGGU | 2125 |
| AD-292251.1 | UCUAUCGCUCUCUAAAUCAGGUG | 2126 |
| AD-292252.1 | CUAUCGCUCUCUAAAUCAGGUGA | 2127 |
| AD-292253.1 | UAUCGCUCUCUAAAUCAGGUGAA | 2128 |
| AD-292254.1 | AUCGCUCUCUAAAUCAGGUGAAG | 2129 |
| AD-292257.1 | GCUCUCUAAAUCAGGUGAAGAAA | 2130 |
| AD-292309.1 | UAAUGCUGGGACAGUAUAUCCAG | 2131 |
| AD-292310.1 | AAUGCUGGGACAGUAUAUCCAGC | 2132 |
| AD-292315.1 | UGGGACAGUAUAUCCAGCCGAUC | 2133 |

TABLE 10-continued

| HSD17B13 NonF DNA Modified Sequence* | | |
|---|---|---|
| AD-292318.1 | GACAGUAUAUCCAGCCGAUCUUC | 2134 |
| AD-292344.1 | GCACCAAGGAUGAAGAGAUUACC | 2135 |
| AD-292345.1 | CACCAAGGAUGAAGAGAUUACCA | 2136 |
| AD-292346.1 | ACCAAGGAUGAAGAGAUUACCAA | 2137 |
| AD-292363.1 | UACCAAGACAUUUGAGGUCAACA | 2138 |
| AD-292366.1 | CAAGACAUUUGAGGUCAACAUCC | 2139 |
| AD-292367.1 | AAGACAUUUGAGGUCAACAUCCU | 2140 |
| AD-292369.1 | GACAUUUGAGGUCAACAUCCUAG | 2141 |
| AD-292370.1 | ACAUUUGAGGUCAACAUCCUAGG | 2142 |
| AD-292371.1 | CAUUUGAGGUCAACAUCCUAGGA | 2143 |
| AD-292373.1 | UUUGAGGUCAACAUCCUAGGACA | 2144 |
| AD-292374.1 | UUGAGGUCAACAUCCUAGGACAU | 2145 |
| AD-292376.1 | GAGGUCAACAUCCUAGGACAUUU | 2146 |
| AD-292377.1 | AGGUCAACAUCCUAGGACAUUUU | 2147 |
| AD-292379.1 | GUCAACAUCCUAGGACAUUUUUG | 2148 |
| AD-292380.1 | UCAACAUCCUAGGACAUUUUUGG | 2149 |
| AD-292381.1 | CAACAUCCUAGGACAUUUUUGGA | 2150 |
| AD-292382.1 | AACAUCCUAGGACAUUUUUGGAU | 2151 |
| AD-292383.1 | ACAUCCUAGGACAUUUUUGGAUC | 2152 |
| AD-292384.1 | CAUCCUAGGACAUUUUUGGAUCA | 2153 |
| AD-292385.1 | AUCCUAGGACAUUUUUGGAUCAC | 2154 |
| AD-292388.1 | CUAGGACAUUUUUGGAUCACAAA | 2155 |
| AD-292389.1 | UAGGACAUUUUUGGAUCACAAAA | 2156 |
| AD-292390.1 | AGGACAUUUUUGGAUCACAAAAG | 2157 |
| AD-292394.1 | CAUUUUUGGAUCACAAAAGCACU | 2158 |
| AD-292397.1 | UUUUGGAUCACAAAAGCACUUCU | 2159 |
| AD-292398.1 | UUUGGAUCACAAAAGCACUUCUU | 2160 |
| AD-292399.1 | UUGGAUCACAAAAGCACUUCUUC | 2161 |
| AD-292403.1 | AUCACAAAAGCACUUCUUCCAUC | 2162 |
| AD-292404.1 | UCACAAAAGCACUUCUUCCAUCG | 2163 |
| AD-292405.1 | CACAAAAGCACUUCUUCCAUCGA | 2164 |
| AD-292406.1 | ACAAAAGCACUUCUUCCAUCGAU | 2165 |
| AD-292407.1 | CAAAAGCACUUCUUCCAUCGAUG | 2166 |
| AD-292408.1 | AAAAGCACUUCUUCCAUCGAUGA | 2167 |
| AD-292409.1 | AAAGCACUUCUUCCAUCGAUGAU | 2168 |
| AD-292410.1 | AAGCACUUCUUCCAUCGAUGAUG | 2169 |
| AD-292434.1 | AGAGAAAUCAUGGCCACAUCGUC | 2170 |
| AD-292486.1 | GAUUCCUUACCUCAUCCCAUAUU | 2171 |
| AD-292487.1 | AUUCCUUACCUCAUCCCAUAUUG | 2172 |
| AD-292492.1 | UUACCUCAUCCCAUAUUGUUCCA | 2173 |
| AD-292495.1 | CCUCAUCCCAUAUUGUUCCAGCA | 2174 |
| AD-292498.1 | CAUCCCAUAUUGUUCCAGCAAAU | 2175 |
| AD-292499.1 | AUCCCAUAUUGUUCCAGCAAAUU | 2176 |
| AD-292526.1 | GCUGUUGGCUUUCACAGAGGUCU | 2177 |
| AD-292531.1 | UGGCUUUCACAGAGGUCUGACAU | 2178 |
| AD-292534.1 | CUUUCACAGAGGUCUGACAUCAG | 2179 |
| AD-292536.1 | UUCACAGAGGUCUGACAUCAGAA | 2180 |
| AD-292541.1 | AGAGGUCUGACAUCAGAACUUCA | 2181 |
| AD-292566.1 | CCUUGGGAAAAACUGGUAUCAAA | 2182 |
| AD-292574.1 | AAAACUGGUAUCAAAACCUCAUG | 2183 |
| AD-292575.1 | AAACUGGUAUCAAAACCUCAUGU | 2184 |
| AD-292576.1 | AACUGGUAUCAAAACCUCAUGUC | 2185 |
| AD-292577.1 | ACUGGUAUCAAAACCUCAUGUCU | 2186 |
| AD-292578.1 | CUGGUAUCAAAACCUCAUGUCUC | 2187 |
| AD-292579.1 | UGGUAUCAAAACCUCAUGUCUCU | 2188 |
| AD-292582.1 | UAUCAAAACCUCAUGUCUCUGCC | 2189 |
| AD-292596.1 | GUCUCUGCCCAGUUUUUGUGAAU | 2190 |
| AD-292601.1 | UGCCCAGUUUUUGUGAAUACUGG | 2191 |
| AD-292606.1 | AGUUUUUGUGAAUACUGGGUUCA | 2192 |
| AD-292607.1 | GUUUUUGUGAAUACUGGGUUCAC | 2193 |
| AD-292610.1 | UUUGUGAAUACUGGGUUCACCAA | 2194 |
| AD-292612.1 | UGUGAAUACUGGGUUCACCAAAA | 2195 |
| AD-292613.1 | GUGAAUACUGGGUUCACCAAAAA | 2196 |
| AD-292614.1 | UGAAUACUGGGUUCACCAAAAAU | 2197 |
| AD-292615.1 | GAAUACUGGGUUCACCAAAAAUC | 2198 |
| AD-292616.1 | AAUACUGGGUUCACCAAAAAUCC | 2199 |
| AD-292624.1 | GUUCACCAAAAAUCCAAGCACAA | 2200 |
| AD-292625.1 | UUCACCAAAAAUCCAAGCACAAG | 2201 |
| AD-292629.1 | CCAAAAAUCCAAGCACAAGAUUA | 2202 |
| AD-292630.1 | CAAAAAUCCAAGCACAAGAUUAU | 2203 |
| AD-292631.1 | AAAAAUCCAAGCACAAGAUUAUG | 2204 |
| AD-292634.1 | AAUCCAAGCACAAGAUUAUGGCC | 2205 |
| AD-292638.1 | CAAGCACAAGAUUAUGGCCUGUA | 2206 |
| AD-292639.1 | AAGCACAAGAUUAUGGCCUGUAU | 2207 |
| AD-292640.1 | AGCACAAGAUUAUGGCCUGUAUU | 2208 |
| AD-292641.1 | GCACAAGAUUAUGGCCUGUAUUG | 2209 |
| AD-292642.1 | CACAAGAUUAUGGCCUGUAUUGG | 2210 |
| AD-292646.1 | AGAUUAUGGCCUGUAUUGGAGAC | 2211 |

TABLE 10-continued

| HSD17B13 NonF DNA Modified Sequence* | | |
|---|---|---|
| AD-292650.1 | UAUGGCCUGUAUUGGAGACAGAU | 2212 |
| AD-292651.1 | AUGGCCUGUAUUGGAGACAGAUG | 2213 |
| AD-292652.1 | UGGCCUGUAUUGGAGACAGAUGA | 2214 |
| AD-292667.1 | ACAGAUGAAGUCGUAAGAAGUCU | 2215 |
| AD-292668.1 | CAGAUGAAGUCGUAAGAAGUCUG | 2216 |
| AD-292671.1 | AUGAAGUCGUAAGAAGUCUGAUA | 2217 |
| AD-292673.1 | GAAGUCGUAAGAAGUCUGAUAGA | 2218 |
| AD-292677.1 | UCGUAAGAAGUCUGAUAGAUGGA | 2219 |
| AD-292678.1 | CGUAAGAAGUCUGAUAGAUGGAA | 2220 |
| AD-292679.1 | GUAAGAAGUCUGAUAGAUGGAAU | 2221 |
| AD-292680.1 | UAAGAAGUCUGAUAGAUGGAAUA | 2222 |
| AD-292681.1 | AAGAAGUCUGAUAGAUGGAAUAC | 2223 |
| AD-292682.1 | AGAAGUCUGAUAGAUGGAAUACU | 2224 |
| AD-292684.1 | AAGUCUGAUAGAUGGAAUACUUA | 2225 |
| AD-292685.1 | AGUCUGAUAGAUGGAAUACUUAC | 2226 |
| AD-292691.1 | AUAGAUGGAAUACUUACCAAUAA | 2227 |
| AD-292692.1 | UAGAUGGAAUACUUACCAAUAAG | 2228 |
| AD-292693.1 | AGAUGGAAUACUUACCAAUAAGA | 2229 |
| AD-292694.1 | GAUGGAAUACUUACCAAUAAGAA | 2230 |
| AD-292695.1 | AUGGAAUACUUACCAAUAAGAAA | 2231 |
| AD-292696.1 | UGGAAUACUUACCAAUAAGAAAA | 2232 |
| AD-292697.1 | GGAAUACUUACCAAUAAGAAAAU | 2233 |
| AD-292725.1 | UUGUUCCAUCGUAUAUCAAUAUC | 2234 |
| AD-292726.1 | UGUUCCAUCGUAUAUCAAUAUCU | 2235 |
| AD-292727.1 | GUUCCAUCGUAUAUCAAUAUCUU | 2236 |
| AD-292728.1 | UUCCAUCGUAUAUCAAUAUCUUU | 2237 |
| AD-292757.1 | CUACAGAAGUUUCUUCCUGAACG | 2238 |
| AD-292759.1 | ACAGAAGUUUCUUCCUGAACGCG | 2239 |
| AD-292761.1 | AGAAGUUUCUUCCUGAACGCGCC | 2240 |
| AD-292766.1 | UUUCUUCCUGAACGCGCCUCAGC | 2241 |
| AD-292787.1 | GCGAUUUAAAUCGUAUGCAGAA | 2242 |
| AD-292788.1 | CGAUUUUAAAUCGUAUGCAGAAU | 2243 |
| AD-292789.1 | GAUUUUAAAUCGUAUGCAGAAUA | 2244 |
| AD-292793.1 | UUAAAUCGUAUGCAGAAUAUUCA | 2245 |
| AD-292795.1 | AAAUCGUAUGCAGAAUAUUCAAU | 2246 |
| AD-292796.1 | AAUCGUAUGCAGAAUAUUCAAUU | 2247 |
| AD-292797.1 | AUCGUAUGCAGAAUAUUCAAUUU | 2248 |
| AD-292800.1 | GUAUGCAGAAUAUUCAAUUUGAA | 2249 |
| AD-292802.1 | AUGCAGAAUAUUCAAUUUGAAGC | 2250 |
| AD-292806.1 | AGAAUAUUCAAUUUGAAGCAGUG | 2251 |
| AD-292808.1 | AAUAUUCAAUUUGAAGCAGUGGU | 2252 |
| AD-292870.1 | GAGAUGUAUGCAUGAUAAUGAUA | 2253 |
| AD-292893.1 | UGAAUAGUUUCGAAUCAAUGCUG | 2254 |
| AD-292906.1 | AUCAAUGCUGCAAAGCUUUAUUU | 2255 |
| AD-292915.1 | GCAAAGCUUUAUUUCACAUUUUU | 2256 |
| AD-292935.1 | UUAAAAACAUUGGUUUGGCACUA | 2257 |
| AD-292936.1 | UAAAAACAUUGGUUUGGCACUAG | 2258 |
| AD-292967.1 | AAACGAACAAGAUUAAUUACCUG | 2259 |
| AD-292970.1 | CGAACAAGAUUAAUUACCUGUCU | 2260 |
| AD-292974.1 | CAAGAUUAAUUACCUGUCUUCCU | 2261 |
| AD-292975.1 | AAGAUUAAUUACCUGUCUUCCUG | 2262 |
| AD-292978.1 | AUUAAUUACCUGUCUUCCUGUUU | 2263 |
| AD-292979.1 | UUAAUUACCUGUCUUCCUGUUUC | 2264 |
| AD-292980.1 | UAAUUACCUGUCUUCCUGUUUCU | 2265 |
| AD-292981.1 | AAUUACCUGUCUUCCUGUUUCUC | 2266 |
| AD-292982.1 | AUUACCUGUCUUCCUGUUUCUCA | 2267 |
| AD-292983.1 | UUACCUGUCUUCCUGUUUCUCAA | 2268 |
| AD-292984.1 | UACCUGUCUUCCUGUUUCUCAAG | 2269 |
| AD-293027.1 | UAGGUCUGUUUUCCUUUCAUGC | 2270 |
| AD-293028.1 | AGGUCUGUUUUCCUUUCAUGCC | 2271 |
| AD-293034.1 | GUUUUCCUUUCAUGCCUCUUAA | 2272 |
| AD-293037.1 | UUCCUUUCAUGCCUCUUAAAAA | 2273 |
| AD-293039.1 | UCCUUUCAUGCCUCUUAAAAACU | 2274 |
| AD-293099.1 | UAUUUUUCCAUUUAAAGGUGGAC | 2275 |
| AD-293153.1 | AGAACUUAUUUACACAGGGAAGG | 2276 |
| AD-293156.1 | ACUUAUUUACACAGGGAAGGUUU | 2277 |
| AD-293162.1 | UUACACAGGGAAGGUUUAAGACU | 2278 |
| AD-293163.1 | UACACAGGGAAGGUUUAAGACUG | 2279 |
| AD-293166.1 | ACAGGGAAGGUUUAAGACUGUUC | 2280 |
| AD-293167.1 | CAGGGAAGGUUUAAGACUGUUCA | 2281 |
| AD-293168.1 | AGGGAAGGUUUAAGACUGUUCAA | 2282 |
| AD-293169.1 | GGGAAGGUUUAAGACUGUUCAAG | 2283 |
| AD-293170.1 | GGAAGGUUUAAGACUGUUCAAGU | 2284 |
| AD-293171.1 | GAAGGUUUAAGACUGUUCAAGUA | 2285 |
| AD-293172.1 | AAGGUUUAAGACUGUUCAAGUAG | 2286 |
| AD-293174.1 | GGUUUAAGACUGUUCAAGUAGCA | 2287 |
| AD-293176.1 | UUUAAGACUGUUCAAGUAGCAUU | 2288 |
| AD-293177.1 | UUAAGACUGUUCAAGUAGCAUUC | 2289 |

TABLE 10-continued

| HSD17B13 NonF DNA Modified Sequence* | | |
|---|---|---|
| AD-293178.1 | UAAGACUGUUCAAGUAGCAUUCC | 2290 |
| AD-293179.1 | AAGACUGUUCAAGUAGCAUUCCA | 2291 |
| AD-293180.1 | AGACUGUUCAAGUAGCAUUCCAA | 2292 |
| AD-293181.1 | GACUGUUCAAGUAGCAUUCCAAU | 2293 |
| AD-293182.1 | ACUGUUCAAGUAGCAUUCCAAUC | 2294 |
| AD-293183.1 | CUGUUCAAGUAGCAUUCCAAUCU | 2295 |
| AD-293184.1 | UGUUCAAGUAGCAUUCCAAUCUG | 2296 |
| AD-293186.1 | UUCAAGUAGCAUUCCAAUCUGUA | 2297 |
| AD-293187.1 | UCAAGUAGCAUUCCAAUCUGUAG | 2298 |
| AD-293191.1 | GUAGCAUUCCAAUCUGUAGCCAU | 2299 |
| AD-293218.1 | CAGAAUAUCAACAAGAACACAGA | 2300 |
| AD-293228.1 | ACAAGAACACAGAAUGAGUGCAC | 2301 |
| AD-293230.1 | AAGAACACAGAAUGAGUGCACAG | 2302 |
| AD-293231.1 | AGAACACAGAAUGAGUGCACAGC | 2303 |
| AD-293235.1 | CACAGAAUGAGUGCACAGCUAAG | 2304 |
| AD-293271.1 | GCAGGCAGCUUUAUCUCAACCUG | 2305 |
| AD-293273.1 | AGGCAGCUUUAUCUCAACCUGGA | 2306 |
| AD-293306.1 | GAUUCAGCAUUUGAAAGAUUUCC | 2307 |
| AD-293309.1 | UCAGCAUUUGAAAGAUUUCCCUA | 2308 |
| AD-293311.1 | AGCAUUUGAAAGAUUUCCCUAGC | 2309 |
| AD-293312.1 | GCAUUUGAAAGAUUUCCCUAGCC | 2310 |
| AD-293315.1 | UUUGAAAGAUUUCCCUAGCCUCU | 2311 |
| AD-293316.1 | UUGAAAGAUUUCCCUAGCCUCUU | 2312 |
| AD-293323.1 | AUUUCCCUAGCCUCUUCCUUUUU | 2313 |
| AD-293353.1 | CCAAAACGGUGCAACUCUAUUCU | 2314 |
| AD-293354.1 | CAAAACGGUGCAACUCUAUUCUG | 2315 |
| AD-293355.1 | AAAACGGUGCAACUCUAUUCUGG | 2316 |
| AD-293358.1 | ACGGUGCAACUCUAUUCUGGACU | 2317 |
| AD-293359.1 | CGGUGCAACUCUAUUCUGGACUU | 2318 |
| AD-293360.1 | GGUGCAACUCUAUUCUGGACUUU | 2319 |
| AD-293361.1 | GUGCAACUCUAUUCUGGACUUUA | 2320 |
| AD-293362.1 | UGCAACUCUAUUCUGGACUUUAU | 2321 |
| AD-293363.1 | GCAACUCUAUUCUGGACUUUAUU | 2322 |
| AD-293364.1 | CAACUCUAUUCUGGACUUUAUUA | 2323 |
| AD-293365.1 | AACUCUAUUCUGGACUUUAUUAC | 2324 |
| AD-293368.1 | UCUAUUCUGGACUUUAUUACUUG | 2325 |
| AD-293369.1 | CUAUUCUGGACUUUAUUACUUGA | 2326 |
| AD-293370.1 | UAUUCUGGACUUUAUUACUUGAU | 2327 |
| AD-293410.1 | UCUGAAGUCCACCAAAAGUGGAC | 2328 |
| AD-293419.1 | CACCAAAAGUGGACCCUCUAUAU | 2329 |
| AD-293420.1 | ACCAAAAGUGGACCCUCUAUAUU | 2330 |
| AD-293422.1 | CAAAAGUGGACCCUCUAUAUUUC | 2331 |
| AD-293423.1 | AAAAGUGGACCCUCUAUAUUUCC | 2332 |
| AD-293530.1 | UGCUUUCAUAUAUCCUUGGUCCC | 2333 |
| AD-293532.1 | CUUUCAUAUAUCCUUGGUCCCAG | 2334 |
| AD-293554.1 | GAGAUGUUUAGACAAUUUUAGGC | 2335 |
| AD-293555.1 | AGAUGUUUAGACAAUUUUAGGCU | 2336 |
| AD-293557.1 | AUGUUUAGACAAUUUUAGGCUCA | 2337 |
| AD-293558.1 | UGUUUAGACAAUUUUAGGCUCAA | 2338 |
| AD-293559.1 | GUUUAGACAAUUUUAGGCUCAAA | 2339 |
| AD-293560.1 | UUUAGACAAUUUUAGGCUCAAAA | 2340 |
| AD-293562.1 | UAGACAAUUUUAGGCUCAAAAAU | 2341 |
| AD-293569.1 | UUUUAGGCUCAAAAAUUAAAGCU | 2342 |
| AD-293570.1 | UUUAGGCUCAAAAAUUAAAGCUA | 2343 |
| AD-293571.1 | UUAGGCUCAAAAAUUAAAGCUAA | 2344 |
| AD-293572.1 | UAGGCUCAAAAAUUAAAGCUAAC | 2345 |
| AD-293573.1 | AGGCUCAAAAAUUAAAGCUAACA | 2346 |
| AD-293574.1 | GGCUCAAAAAUUAAAGCUAACAC | 2347 |
| AD-293575.1 | GCUCAAAAAUUAAAGCUAACACA | 2348 |
| AD-293576.1 | CUCAAAAAUUAAAGCUAACACAG | 2349 |
| AD-293579.1 | AAAAAUUAAAGCUAACACAGGAA | 2350 |
| AD-293586.1 | AAAGCUAACACAGGAAAAGGAAC | 2351 |
| AD-293589.1 | GCUAACACAGGAAAAGGAACUGU | 2352 |
| AD-293592.1 | AACACAGGAAAAGGAACUGUACU | 2353 |
| AD-293594.1 | CACAGGAAAAGGAACUGUACUGG | 2354 |
| AD-293601.1 | AAAGGAACUGUACUGGCUAUUAC | 2355 |
| AD-293602.1 | AAGGAACUGUACUGGCUAUUACA | 2356 |
| AD-293872.1 | UCCGACUCCCACUACAUCAAGAC | 2357 |
| AD-293875.1 | GACUCCCACUACAUCAAGACUAA | 2358 |
| AD-293876.1 | ACUCCCACUACAUCAAGACUAAU | 2359 |
| AD-293877.1 | CUCCCACUACAUCAAGACUAAUC | 2360 |
| AD-293878.1 | UCCCACUACAUCAAGACUAAUCU | 2361 |
| AD-293879.1 | CCCACUACAUCAAGACUAAUCUU | 2362 |
| AD-293880.1 | CCACUACAUCAAGACUAAUCUUG | 2363 |
| AD-293881.1 | CACUACAUCAAGACUAAUCUUGU | 2364 |
| AD-293882.1 | ACUACAUCAAGACUAAUCUUGUU | 2365 |
| AD-293883.1 | CUACAUCAAGACUAAUCUUGUUU | 2366 |
| AD-293898.1 | UUUUGUGUGUUUUUCACAUGUAU | 2367 |

TABLE 10-continued

HSD17B13 NonF DNA Modified Sequence*

| | | |
|---|---|---|
| AD-293902.1 | GUGUGUUUUCACAUGUAUUAUA | 2368 |
| AD-293909.1 | UUUCACAUGUAUUAUAGAAUGCU | 2369 |
| AD-293910.1 | UUCACAUGUAUUAUAGAAUGCUU | 2370 |
| AD-293914.1 | CAUGUAUUAUAGAAUGCUUUUGC | 2371 |
| AD-293915.1 | AUGUAUUAUAGAAUGCUUUUGCA | 2372 |
| AD-293919.1 | AUUAUAGAAUGCUUUUGCAUGGA | 2373 |
| AD-293922.1 | AUAGAAUGCUUUUGCAUGGACUA | 2374 |
| AD-293923.1 | UAGAAUGCUUUUGCAUGGACUAU | 2375 |
| AD-293925.1 | GAAUGCUUUUGCAUGGACUAUCC | 2376 |
| AD-293928.1 | UGCUUUUGCAUGGACUAUCCUCU | 2377 |
| AD-293931.1 | UUUUGCAUGGACUAUCCUCUUGU | 2378 |
| AD-293932.1 | UUUGCAUGGACUAUCCUCUUGUU | 2379 |
| AD-293933.1 | UUGCAUGGACUAUCCUCUUGUUU | 2380 |
| AD-293934.1 | UGCAUGGACUAUCCUCUUGUUUU | 2381 |
| AD-293935.1 | GCAUGGACUAUCCUCUUGUUUUU | 2382 |
| AD-293936.1 | CAUGGACUAUCCUCUUGUUUUUA | 2383 |
| AD-293937.1 | AUGGACUAUCCUCUUGUUUUUAU | 2384 |
| AD-293938.1 | UGGACUAUCCUCUUGUUUUUAUU | 2385 |
| AD-293940.1 | GACUAUCCUCUUGUUUUUAUUAA | 2386 |

*Target: HSD17B13

TABLE 11

HSD17B13 NonF DNA Unmodified Sequence*

| Duplex Name | Sense sequence 5' to 3' | SEQ ID NO: | Position in NM_178135.4 | Antisense sequence 5' to 3' | SEQ ID NO: | Range in NM_178135.4 |
|---|---|---|---|---|---|---|
| AD-291929.1 | ACACAAGGACTGAACCAGAAU | 2387 | 25-45 | ATUCTGGUUCAGUCCUUGUGUAG | 2682 | 23-45 |
| AD-291931.1 | ACAAGGACTGAACCAGAAGGA | 2388 | 27-47 | UCCUUCTGGUUCAGUCCUUGUGU | 2683 | 25-47 |
| AD-291988.1 | UCCUUCUGCUUCUGAUCACCA | 2389 | 85-105 | UGGUGAUCAGAAGCAGAAGGAUU | 2684 | 83-105 |
| AD-291993.1 | CUGCUUCUGATCACCAUCAUU | 2390 | 90-110 | AAUGAUGGUGAUCAGAAGCAGAA | 2685 | 88-110 |
| AD-291998.1 | UCUGAUCACCAUCAUCUACUU | 2391 | 95-115 | AAGUAGAUGAUGGTGAUCAGAAG | 2686 | 93-115 |
| AD-292005.1 | ACCAUCAUCUACUCCUACUUU | 2392 | 102-122 | AAAGUAGGAGUAGAUGAUGGUGA | 2687 | 100-122 |
| AD-292006.1 | CCAUCAUCUACUCCUACUUGU | 2393 | 103-123 | ACAAGUAGGAGUAGAUGAUGGUG | 2688 | 101-123 |
| AD-292007.1 | CAUCAUCUACUCCUACUUGGA | 2394 | 104-124 | UCCAAGUAGGAGUAGAUGAUGGU | 2689 | 102-124 |
| AD-292008.1 | AUCAUCUACUCCUACUUGGAU | 2395 | 105-125 | ATCCAAGUAGGAGUAGAUGAUGG | 2690 | 103-125 |
| AD-292010.1 | CAUCUACUCCUACUUGGAGUU | 2396 | 107-127 | AACUCCAAGUAGGAGUAGAUGAU | 2691 | 105-127 |
| AD-292012.1 | UCUACUCCUACUUGGAGUCGU | 2397 | 109-129 | ACGACUCCAAGUAGGAGUAGAUG | 2692 | 107-129 |
| AD-292013.1 | CUACUCCUACUUGGAGUCGUU | 2398 | 110-130 | AACGACUCCAAGUAGGAGUAGAU | 2693 | 108-130 |
| AD-292014.1 | UACUCCUACUUGGAGUCGUUU | 2399 | 111-131 | AAACGACUCCAAGUAGGAGUAGA | 2694 | 109-131 |
| AD-292015.1 | ACUCCUACUUGGAGUCGUUGU | 2400 | 112-132 | ACAACGACUCCAAGUAGGAGUAG | 2695 | 110-132 |
| AD-292017.1 | UCCUACUUGGAGUCGUUGGUU | 2402 | 114-134 | AACCAACGACUCCAAGUAGGAGU | 2697 | 112-134 |
| AD-292028.1 | GUCGUUGGTGAAGUUUUUCAU | 2403 | 125-145 | ATGAAAAACUUCACCAACGACUC | 2698 | 123-145 |
| AD-292137.1 | UUGGUUCUGUGGGAUAUUAAU | 2404 | 252-272 | ATUAAUAUCCACAGAACCAAUA | 2699 | 250-272 |
| AD-292140.1 | GUUCUGUGGGAUAUUAAUAAU | 2405 | 255-275 | AUUAUAAUAUCCCACAGAACCA | 2700 | 253-275 |
| AD-292143.1 | CUGUGGGATATUAAUAAGCGU | 2406 | 258-278 | ACGCUAUUAAUAUCCCACAGAA | 2701 | 256-278 |
| AD-292182.1 | GCUGAGUGCCGAAAACUAGGU | 2407 | 297-317 | ACCUAGUUUUCGGCACUCAGCUG | 2702 | 295-317 |
| AD-292183.1 | CUGAGUGCCGAAAACUAGGCU | 2408 | 298-318 | AGCCUAGUUUUCGGCACUCAGCU | 2703 | 296-318 |
| AD-292185.1 | GAGUGCCGAAAACUAGGCGUU | 2409 | 300-320 | AACGCCUAGUUUUCGGCACUCAG | 2704 | 298-320 |
| AD-292186.1 | AGUGCCGAAAACUAGGCGUCA | 2410 | 301-321 | UGACGCCUAGUUUCGGCACUCA | 2705 | 299-321 |
| AD-292187.1 | GUGCCGAAAACUAGGCGUCAU | 2411 | 302-322 | ATGACGCCUAGUUUCGGCACUC | 2706 | 300-322 |
| AD-292188.1 | UGCCGAAAACUAGGCGUCACU | 2412 | 303-323 | AGUGACGCCUAGUUUCGGCACU | 2707 | 301-323 |
| AD-292189.1 | GCCGAAAACUAGGCGUCACUU | 2413 | 304-324 | AAGUGACGCCUAGUUUUCGGCAC | 2708 | 302-324 |
| AD-292190.1 | CCGAAAACUAGGCGUCACUGU | 2414 | 305-325 | ACAGUGACGCCUAGUUUUCGGCA | 2709 | 303-325 |
| AD-292238.1 | CAGAGAAGAGAUCUAUCGCUU | 2415 | 353-373 | AAGCGAUAGAUCUCUUCUCUGUU | 2710 | 351-373 |
| AD-292244.1 | AGAGAUCUAUCGCUCUCUAAA | 2416 | 359-379 | UUAAGAGAGCGAUAGAUCUCUUC | 2711 | 357-379 |
| AD-292245.1 | GAGAUCUAUCGCUCUCUAAAU | 2417 | 360-380 | AUUAGAGAGCGAUAGAUCUCUU | 2712 | 358-380 |
| AD-292247.1 | GAUCUAUCGCUCUCUAAAUCA | 2418 | 362-382 | UGAUUAGAGAGCGAUAGAUCUC | 2713 | 360-382 |
| AD-292248.1 | AUCUAUCGCUCUCUAAAUCAU | 2419 | 363-383 | ATGAUUUAGAGAGCGAUAGAUCU | 2714 | 361-383 |
| AD-292250.1 | CUAUCGCUCUCUAAAUCAGGU | 2420 | 365-385 | ACCUGAUUUAGAGAGCGAUAGAU | 2715 | 363-385 |
| AD-292251.1 | UAUCGCUCUCUAAAUCAGGUU | 2421 | 366-386 | AACCUGAUUUAGAGAGCGAUAGA | 2716 | 364-386 |
| AD-292253.1 | UCGCUCUCUAAAUCAGGUGAA | 2423 | 368-388 | UUCACCUGAUUUAGAGAGCGAUA | 2718 | 366-388 |
| AD-292254.1 | CGCUCUCUAAAUCAGGUGAAU | 2424 | 369-389 | AUUCACCUGAUUUAGAGAGCGAU | 2719 | 367-389 |
| AD-292257.1 | UCUCUAAAUCAGGUGAAGAAA | 2425 | 372-392 | UUUCUUCACCUGAUUUAGAGAGC | 2720 | 370-392 |
| AD-292309.1 | AUGCUGGGACAGUAUAUCCAU | 2426 | 424-444 | ATGGAUAUACUGUCCCAGCAUUA | 2721 | 422-444 |
| AD-292310.1 | UGCUGGGACAGUAUAUCCAGU | 2427 | 425-445 | ACUGGAUAUACTGUCCCAGCAUU | 2722 | 423-445 |
| AD-292315.1 | GGACAGUATAUCCAGCCGAUU | 2428 | 430-450 | AAUCGGCUGGAUAUACUGUCCCA | 2723 | 428-450 |
| AD-292318.1 | CAGUAUAUCCAGCCGAUCAUU | 2429 | 433-453 | AAAGAUCGGCUGGAUAUACUGUC | 2724 | 431-453 |
| AD-292344.1 | ACCAAGGATGAAGAGAUUACU | 2430 | 459-479 | AGUAAUCUCUUCAUCCUUGGUGC | 2725 | 457-479 |
| AD-292345.1 | CCAAGGAUGAAGAGAUUACCA | 2431 | 460-480 | UGGUAAUCUCUCAUCCUUGGUG | 2726 | 458-480 |
| AD-292346.1 | CAAGGAUGAAGAGAUUACCAA | 2432 | 461-481 | UUGGUAAUCUCUUCAUCCUUGGU | 2727 | 459-481 |
| AD-292363.1 | CCAAGACAUUUGAGGUCAACA | 2433 | 478-498 | UGUUGACCUCAAAUGUCUUGGUA | 2728 | 476-498 |
| AD-292366.1 | AGACAUUUGAGGUCAACAUCU | 2434 | 481-501 | AGAUGUUGACCTCAAAUGUCUUG | 2729 | 479-501 |

TABLE 11-continued

HSD17B13 NonF DNA Unmodified Sequence*

| Duplex Name | Sense sequence 5' to 3' | SEQ ID NO: | Position in NM_178135.4 | Antisense sequence 5' to 3' | SEQ ID NO: | Range in NM_178135.4 |
|---|---|---|---|---|---|---|
| AD-292367.1 | GACAUUUGAGGUCAACAUCCU | 2435 | 482-502 | AGGAUGUUGACCUCAAAUGUCUU | 2730 | 480-502 |
| AD-292369.1 | CAUUUGAGGUCAACAUCCUAU | 2436 | 484-504 | AUAGGAUGUUGACCUCAAAUGUC | 2731 | 482-504 |
| AD-292370.1 | AUUUGAGGUCAACAUCCUAGU | 2437 | 485-505 | ACUAGGAUGUUGACCUCAAAUGU | 2732 | 483-505 |
| AD-292371.1 | UUUGAGGUCAACAUCCUAGGA | 2438 | 486-506 | UCCUAGGAUGUUGACCUCAAAUG | 2733 | 484-506 |
| AD-292373.1 | UGAGGUCAACAUCCUAGGACA | 2439 | 488-508 | UGUCCUAGGAUGUUGACCUCAAA | 2734 | 486-508 |
| AD-292374.1 | GAGGUCAACAUCCUAGGACAU | 2440 | 489-509 | AUGUCCUAGGAUGUUGACCUCAA | 2735 | 487-509 |
| AD-292376.1 | GGUCAACAUCCUAGGACAUUU | 2441 | 491-511 | AAAUGUCCUAGGAUGUUGACCUC | 2736 | 489-511 |
| AD-292377.1 | GUCAACAUCCUAGGACAUUUU | 2442 | 492-512 | AAAAUGUCCUAGGAUGUUGACCU | 2737 | 490-512 |
| AD-292379.1 | CAACAUCCUAGGACAUUUUUG | 2443 | 494-514 | CAAAAAUGUCCUAGGAUGUUGAC | 2738 | 492-514 |
| AD-292380.1 | AACAUCCUAGGACAUUUUUGU | 2444 | 495-515 | ACAAAAAUGUCCUAGGAUGUUGA | 2739 | 493-515 |
| AD-292381.1 | ACAUCCUAGGACAUUUUUGGA | 2445 | 496-516 | UCCAAAAAUGUCCUAGGAUGUUG | 2740 | 494-516 |
| AD-292382.1 | CAUCCUAGGACAUUUUUGGAU | 2446 | 497-517 | AUCCAAAAAUGUCCUAGGAUGUU | 2741 | 495-517 |
| AD-292383.1 | AUCCUAGGACAUUUUUGGAUU | 2447 | 498-518 | AAUCCAAAAAUGUCCUAGGAUGU | 2742 | 496-518 |
| AD-292384.1 | UCCUAGGACAUUUUUGGAUCA | 2448 | 499-519 | UGAUCCAAAAAUGUCCUAGGAUG | 2743 | 497-519 |
| AD-292385.1 | CCUAGGACAUUUUUGGAUCAU | 2449 | 500-520 | AUGAUCCAAAAAUGUCCUAGGAU | 2744 | 498-520 |
| AD-292388.1 | AGGACAUUUUGGAUCACAAA | 2450 | 503-523 | UUGUGAUCCAAAAAUGUCCUAG | 2745 | 501-523 |
| AD-292389.1 | GGACAUUUUGGAUCACAAAA | 2451 | 504-524 | UUUGUGAUCCAAAAAUGUCCUA | 2746 | 502-524 |
| AD-292390.1 | GACAUUUUGGAUCACAAAAU | 2452 | 505-525 | AUUUGUGAUCCAAAAAUGUCCU | 2747 | 503-525 |
| AD-292394.1 | UUUUUGGAUCACAAAAGCACU | 2453 | 509-529 | AGUGCUUUUGUGAUCCAAAAAUG | 2748 | 507-529 |
| AD-292397.1 | UUGGAUCACAAAAGCACUUCU | 2454 | 512-532 | AGAAGUGCUUUUGUGAUCCAAAA | 2749 | 510-532 |
| AD-292398.1 | UGGAUCACAAAAGCACUUCUU | 2455 | 513-533 | AAGAAGUGCUUUUGUGAUCCAAA | 2750 | 511-533 |
| AD-292399.1 | GGAUCACAAAAGCACUUCUUU | 2456 | 514-534 | AAAGAAGUGCUUUUGUGAUCCAA | 2751 | 512-534 |
| AD-292403.1 | CACAAAAGCACUUCUUCCAGG | 2457 | 518-538 | AAUGGAAGAAGUGCUUUUGUGAU | 2752 | 516-538 |
| AD-292404.1 | ACAAAAGCACUUCUUCCAUCU | 2458 | 519-539 | AGAUGGAAGAAGUGCUUUUGUGA | 2753 | 517-539 |
| AD-292405.1 | CAAAAGCACUUCUUCCAUCGA | 2459 | 520-540 | UCGAUGGAAGAAGUGCUUUUGUG | 2754 | 518-540 |
| AD-292406.1 | AAAAGCACUCUUCCAUCGAU | 2460 | 521-541 | AUCGAUGGAAGAAGUGCUUUUGU | 2755 | 519-541 |
| AD-292407.1 | AAAGCACUCUUCCAUCGAUU | 2461 | 522-542 | AAUCGAUGGAAGAAGUGCUUUUG | 2756 | 520-542 |
| AD-292409.1 | AGCACUUCUCCAUCGAUGAU | 2463 | 524-544 | AUCAUCGAUGGAAGAAGUGCUUU | 2758 | 522-544 |
| AD-292410.1 | GCACUUCUCCAUCGAUGAUU | 2464 | 525-545 | AAUCAUCGAUGGAAGAAGUGCUU | 2759 | 523-545 |
| AD-292434.1 | AGAAAUCAUGGCCACAUCGUU | 2465 | 549-569 | AACGAUGUGGCCAUGAUUUCUCU | 2760 | 547-569 |
| AD-292486.1 | UUCCUAACCUCAUCCCAUAUU | 2466 | 601-621 | AAUAUGGGAUGAGGUAAGGAAUC | 2761 | 599-621 |
| AD-292487.1 | UCCUUACCUCAUCCCAUAUUU | 2467 | 602-622 | AAAAUAUGGGAUGAGGUAAGGAAU | 2762 | 600-622 |
| AD-292492.1 | ACCUCAUCCCAUAUUGUUCCA | 2468 | 607-627 | UGGAACAAUAUGGGAUGAGGUAA | 2763 | 605-627 |
| AD-292495.1 | UCAUCCCAUAUUGUUCCAGCA | 2469 | 610-630 | UGCUGGAACAAUAUGGGAUGAGG | 2764 | 608-630 |
| AD-292498.1 | UCCCAUAUUGUUCCAGCAAAU | 2470 | 613-633 | AUUGCUGGAACAAUAUGGGAUG | 2765 | 611-633 |
| AD-292499.1 | CCCAUAUUGUUCCAGCAAAUU | 2471 | 614-634 | AAUUGCUGGAACAAUAUGGGAU | 2766 | 612-634 |
| AD-292526.1 | UGUUGGCUUCACAGAGGUCU | 2472 | 641-661 | AGACCUCUGUGAAAGCCAACAGC | 2767 | 639-661 |
| AD-292531.1 | GCUUCACAGAGGUCUGACAU | 2473 | 646-666 | AUGUCAGACCUCUGUGAAAGCCA | 2768 | 644-666 |
| AD-292534.1 | UUCACAGAGGUCUGACAUCAU | 2474 | 649-669 | AUGAUGUCAGACCUCUGUGAAAG | 2769 | 647-669 |
| AD-292536.1 | CACAGAGGUCUGACAUCAGAA | 2475 | 651-671 | UUCUGAUGUCAGACCUCUGUGAA | 2770 | 649-671 |
| AD-292541.1 | AGGUCUGACAUCAGAACUUCA | 2476 | 656-676 | UGAAGUUCUGAUGUCAGACCUCU | 2771 | 654-676 |
| AD-292566.1 | UUGGGAAAAACUGGUAUCAAA | 2477 | 681-701 | UUUGAUACCAGUUUUUCCCAAGG | 2772 | 679-701 |
| AD-292574.1 | AACUGGUAUCAAAACCUCAUU | 2478 | 689-709 | AAUGAGGUUUUGAUACCAGUUUU | 2773 | 687-709 |
| AD-292575.1 | ACUGGUAUCAAAACCUCAUGU | 2479 | 690-710 | ACAUGAGGUUUUGAUACCAGUUU | 2774 | 688-710 |
| AD-292576.1 | CUGGUAUCAAAACCUCAUGUU | 2480 | 691-711 | AACAUGAGGUUUUGAUACCAGUU | 2775 | 689-711 |
| AD-292577.1 | UGGUAUCAAAACCUCAUGUCU | 2481 | 692-712 | AGACAUGAGGUUUUGAUACCAGU | 2776 | 690-712 |
| AD-292578.1 | GGUAUCAAAACCUCAUGUCUU | 2482 | 693-713 | AAGACAUGAGGUUUUGAUACCAG | 2777 | 691-713 |
| AD-292579.1 | GUAUCAAAACCUCAUGUCUCU | 2483 | 694-714 | AGAGACAUGAGGUUUUGAUACCA | 2778 | 692-714 |
| AD-292582.1 | UCAAAACCUCAUGUCUCUGCU | 2484 | 697-717 | AGCAGAGACAUGAGGUUUUGAUA | 2779 | 695-717 |
| AD-292596.1 | CUCUGCCCAGUUUUUGUGAAU | 2485 | 711-731 | AUUCACAAAAACUGGGCAGAGAC | 2780 | 709-731 |
| AD-292601.1 | CCCAGUUUUUGUGAAUACUGU | 2486 | 716-736 | ACAGUAUUCACAAAAACUGGGCA | 2781 | 714-736 |
| AD-292606.1 | UUUUUGUGAAUACUGGGUUCA | 2487 | 721-741 | UGAACCCAGUAUUCACAAAAACU | 2782 | 719-741 |
| AD-292607.1 | UUUUGUGAAUACUGGGUUCAU | 2488 | 722-742 | AUGAACCCAGUAUUCACAAAAAC | 2783 | 720-742 |
| AD-292610.1 | UGUGAAUACUGGGUUCACCAA | 2489 | 725-745 | UUGGUGAACCCAGUAUUCACAAA | 2784 | 723-745 |
| AD-292612.1 | UGAAUACUGGGUUCACCAAAA | 2490 | 727-747 | UUUUGGUGAACCCAGUAUUCACA | 2785 | 725-747 |
| AD-292613.1 | GAAUACUGGGUCACCAAAAA | 2491 | 728-748 | UUUUGGUGAACCCAGUAUUCAC | 2786 | 726-748 |
| AD-292614.1 | AAUACUGGGUCACCAAAAAU | 2492 | 729-749 | AUUUGGUGAACCCAGUAUUCA | 2787 | 727-749 |
| AD-292615.1 | AUACUGGGUCACCAAAAAUU | 2493 | 730-750 | AAUUUGGUGAACCCAGUAUUC | 2788 | 728-750 |
| AD-292616.1 | UACUGGGUCACCAAAAAUCU | 2494 | 731-751 | AGAUUUGGUGAACCCAGUAUU | 2789 | 729-751 |
| AD-292624.1 | UCACCAAAAAUCCAAGCACAA | 2495 | 739-759 | UGUGCUGGAUUUUGGUGAAC | 2790 | 737-759 |
| AD-292625.1 | CACCAAAAAUCCAAGCACAAU | 2496 | 740-760 | AUUGUGCUGGAUUUUGGUGAA | 2791 | 738-760 |
| AD-292629.1 | AAAAAUCCAAGCACAAGAUUA | 2497 | 744-764 | UAAUCUGUGCUGGAUUUUGG | 2792 | 742-764 |
| AD-292630.1 | AAAAUCCAAGCACAAGAUUAU | 2498 | 745-765 | AUAAUCUGUGCUGGAUUUUUG | 2793 | 743-765 |
| AD-292631.1 | AAAUCCAAGCACAAGAUUAUU | 2499 | 746-766 | AAUAAUCUUGUGCUGGAUUUUU | 2794 | 744-766 |
| AD-292634.1 | UCCAAGCACAAGAUUAUGGCU | 2500 | 749-769 | AGCCAUAAUCUGUGCUUGGAAU | 2795 | 747-769 |
| AD-292639.1 | GCACAAGAUUAUGGCCUGUAU | 2502 | 754-774 | AUACAGGCCAUAAUCUUGUGCUU | 2797 | 752-774 |
| AD-292640.1 | CACAAGAUUAUGGCCUGUAUU | 2503 | 755-775 | AAUACAGGCCAUAAUCUUGUGCU | 2798 | 753-775 |
| AD-292641.1 | ACAAGAUUAUGGCCUGUAUUU | 2504 | 756-776 | AAAUACAGGCCAUAAUCUUGUGC | 2799 | 754-776 |
| AD-292642.1 | CAAGAUUAUGGCCUGUAUUGU | 2505 | 757-777 | ACAAUACAGGCCAUAAUCUUGUG | 2800 | 755-777 |
| AD-292646.1 | AUUAUGGCCUGUAUUGGAGAU | 2506 | 761-781 | AUCUCCAAUACAGGCCAUAAUCU | 2801 | 759-781 |
| AD-292650.1 | UGGCCUGUAUGGAGACAGAU | 2507 | 765-785 | AUCUGUCUCCAAUACAGGCCAUA | 2802 | 763-785 |
| AD-292651.1 | GGCCUGUAUGGAGACAGAUU | 2508 | 766-786 | AAUCUGUCUCCAAUACAGGCCAU | 2803 | 764-786 |
| AD-292652.1 | GCCUGUAUGGAGACAGAUGA | 2509 | 767-787 | UCAUCUGUCUCCAAUACAGGCCA | 2804 | 765-787 |
| AD-292667.1 | AGAUGAAGUCGUAAGAAGUCU | 2510 | 782-802 | AGACUUCUUACGACUUCAUCUGU | 2805 | 780-802 |

TABLE 11-continued

HSD17B13 NonF DNA Unmodified Sequence*

| Duplex Name | Sense sequence 5' to 3' | SEQ ID NO: | Position in NM_178135.4 | Antisense sequence 5' to 3' | SEQ ID NO: | Range in NM_178135.4 |
|---|---|---|---|---|---|---|
| AD-292668.1 | GAUGAAGUCGUAAGAAGUCUU | 2511 | 783-803 | AAGACUTCUUACGACUUCAUCUG | 2806 | 781-803 |
| AD-292671.1 | GAAGUCGUAAGAAGUCUGAUA | 2512 | 786-806 | UAUCAGACUUCUUACGACUUCAU | 2807 | 784-806 |
| AD-292673.1 | AGUCGUAAGAAGUCUGAUAGA | 2513 | 788-808 | UCUAUCAGACUCUACGACUUC | 2808 | 786-808 |
| AD-292677.1 | GUAAGAAGTCTGAUAGAUGGA | 2514 | 792-812 | UCCATCTAUCAGACUUCUUACGA | 2809 | 790-812 |
| AD-292678.1 | UAAGAAGUCUGAUAGAUGGAA | 2515 | 793-813 | UTCCAUCUAUCAGACUUCUUACG | 2810 | 791-813 |
| AD-292679.1 | AAGAAGUCTGAUAGAUGGAAU | 2516 | 794-814 | ATUCCATCUAUCAGACUUCUUAC | 2811 | 792-814 |
| AD-292680.1 | AGAAGUCUGAUAGAUGGAAUA | 2517 | 795-815 | UAUUCCAUCUAUCAGACUUCUUA | 2812 | 793-815 |
| AD-292681.1 | GAAGUCUGAUAGAUGGAAUAU | 2518 | 796-816 | ATAUTCCAUCUAUCAGACUUCUU | 2813 | 794-816 |
| AD-292682.1 | AAGUCUGAUAGAUGGAAUACU | 2519 | 797-817 | AGUAUCCACUCUAUCAGACUUCU | 2814 | 795-817 |
| AD-292684.1 | GUCUGAUAGAUGGAAUACUUA | 2520 | 799-819 | UAAGTAUCCCATCTAUCAGACUU | 2815 | 797-819 |
| AD-292685.1 | UCUGAUAGAUGGAAUACUUAU | 2521 | 800-820 | ATAAGUAUUCCAUCUAUCAGACU | 2816 | 798-820 |
| AD-292691.1 | AGAUGGAAUACUUACCAAUAA | 2522 | 806-826 | UTAUTGGUAAGTAUCCAUCUAU | 2817 | 804-826 |
| AD-292692.1 | GAUGGAAUACUUACCAAUAAU | 2523 | 807-827 | ATUAUGGUAAGUAUUCCAUCUA | 2818 | 805-827 |
| AD-292693.1 | AUGGAAUACUUACCAAUAAGA | 2524 | 808-828 | UCUUAUUGGUAAGUAUUCCAUCU | 2819 | 806-828 |
| AD-292694.1 | UGGAAUACUUACCAAUAAGAA | 2525 | 809-829 | UUCUUAUUGGUAAGUAUUCCAUC | 2820 | 807-829 |
| AD-292695.1 | GGAAUACUUACCAAUAAGAAA | 2526 | 810-830 | UUUCUAUUGGUAAGUAUUCCAU | 2821 | 808-830 |
| AD-292696.1 | GAAUACUUACCAAUAAGAAAA | 2527 | 811-831 | UUUUCUAUUGGUAAGUAUUCCA | 2822 | 809-831 |
| AD-292697.1 | AAUACUUACCAAUAAGAAAAU | 2528 | 812-832 | ATUUTCUAUUGGUAAGUAUUCC | 2823 | 810-832 |
| AD-292725.1 | GUUCCAUCGUAUAUCAAUAUCU | 2529 | 840-860 | AAUAUUGAUAUACGAUGGAACAA | 2824 | 838-860 |
| AD-292726.1 | UUCCAUCGUAUAUCAAUAUCU | 2530 | 841-861 | AGAUAUUGAUAUACGAUGGAAC | 2825 | 839-861 |
| AD-292727.1 | UCCAUCGUAUAUCAAUAUCUU | 2531 | 842-862 | AAGAUAUUGAUAUACGAUGGAAC | 2826 | 840-862 |
| AD-292728.1 | CCAUCGUAUAUCAAUAUCUUU | 2532 | 843-863 | AAAGAUAUUGAUAUACGAUGGAA | 2827 | 841-863 |
| AD-292757.1 | ACAGAAGUUCUUCCUGAACU | 2533 | 872-892 | AGUUCAGGAAGAAACUUCUGUAG | 2828 | 870-892 |
| AD-292759.1 | AGAAGUUUCUCCUGAACGCU | 2534 | 874-894 | AGCGUUCAGGAAGAAACUUCUGU | 2829 | 872-894 |
| AD-292761.1 | AAGUUUCUCCUGAACGCGCU | 2535 | 876-896 | AGCGCGUUCAGGAAGAAACUUCU | 2830 | 874-896 |
| AD-292766.1 | UCUUCCUGAACGCGCCUCAGU | 2536 | 881-901 | ACUGAGGCGCGUUCAGGAAGAAA | 2831 | 879-901 |
| AD-292787.1 | GAUUUUAAAUCGUAUGCAGAA | 2537 | 902-922 | UUCUGCAUACGAUUUAAAAUCGC | 2832 | 900-922 |
| AD-292788.1 | AUUUUAAAUCGUAUGCAGAAU | 2538 | 903-923 | ATUCTGCAUACGAUUUAAAAUCG | 2833 | 901-923 |
| AD-292793.1 | AAAUCGUAUGCAGAAUAUUCA | 2540 | 908-928 | UGAAUAUUCUGCAUACGAUUUAA | 2835 | 906-928 |
| AD-292795.1 | AUCGUAUGCAGAAUAUUCAAU | 2541 | 910-930 | ATUGAAUAUUCUGCAUACGAUUU | 2836 | 908-930 |
| AD-292796.1 | UCGUAUGCAGAAUAUUCAAUU | 2542 | 911-931 | AAUUGAAUAUUCUGCAUACGAUU | 2837 | 909-931 |
| AD-292797.1 | CGUAUGCAGAAUAUUCAAUUU | 2543 | 912-932 | AAAUUGAAUAUUCUGCAUACGAU | 2838 | 910-932 |
| AD-292800.1 | AUGCAGAATATCAAUUUGAA | 2544 | 915-935 | UTCAAAUUGAAUAUUCUGCAUAC | 2839 | 913-935 |
| AD-292802.1 | GCAGAAUATCAAUUUGAAGU | 2545 | 917-937 | ACUUCAAAUUGAAUAUUCUGCAU | 2840 | 915-937 |
| AD-292806.1 | AAUAUUCAAUUGAAGCAGUU | 2546 | 921-941 | AACUGCUUCAAAUUGAAUAUUCU | 2841 | 919-941 |
| AD-292870.1 | GAUGUAUGCATGAUAAUGAUA | 2548 | 989-1009 | UAUCAUUAUCAUGCAUACAUCUC | 2843 | 987-1009 |
| AD-292893.1 | AAUAGUUUCGAAUCAAUGCUU | 2549 | 1012-1032 | AAGCAUUGAUUCGAAACUAUUCA | 2844 | 1010-1032 |
| AD-292906.1 | CAAUGCUGCAAAGCUUUAUUU | 2550 | 1025-1045 | AAAUAAAGCUUUGCAGCAUUGAU | 2845 | 1023-1045 |
| AD-292915.1 | AAAGCUUUAUUCACAUUUUUU | 2551 | 1034-1054 | AAAAAAUGUGAAAUAAAGCUUUGC | 2846 | 1032-1054 |
| AD-292936.1 | AAAACAUUGGUUUGGCACUAU | 2553 | 1073-1093 | ATAGTGCCAAACCAAUGUUUUUA | 2848 | 1071-1093 |
| AD-292967.1 | ACGAACAAGAUAAUUACCUU | 2554 | 1104-1124 | AAGGUAAUUAAUCUGUUCGUUU | 2849 | 1102-1124 |
| AD-292970.1 | AACAAGAUAAUUACCUGUCU | 2555 | 1107-1127 | AGACAGGUAAUUAAUCUUGUUCG | 2850 | 1105-1127 |
| AD-292974.1 | AGAUUAAUUACCUGUCUUCCU | 2556 | 1111-1131 | AGGAAGACAGGUAAUUAAUCUUG | 2851 | 1109-1131 |
| AD-292975.1 | GAUUAAUUACCUGUCUUCCUG | 2557 | 1112-1132 | AAGGAAGACAGGUAAUUAAUCUU | 2852 | 1110-1132 |
| AD-292978.1 | UAAUUACCTGTCUUCCUGUUU | 2558 | 1115-1135 | AAACAGGAAGACAGGUAAUUAAU | 2853 | 1113-1135 |
| AD-292979.1 | AAUUACCUGUCUUCCUGUUUC | 2559 | 1116-1136 | GAAACAGGAAGACAGGUAAUUAA | 2854 | 1114-1136 |
| AD-292980.1 | AUUACCGTCUUCCUGUUUCU | 2560 | 1117-1137 | AGAAACAGGAAGACAGGUAAUUA | 2855 | 1115-1137 |
| AD-292981.1 | UUACCUGUCUUCCUGUUUCUU | 2561 | 1118-1138 | AAGAAACAGGAAGACAGGUAAUU | 2856 | 1116-1138 |
| AD-292982.1 | UACCUGUCUUCCUGUUUCUCA | 2562 | 1119-1139 | UGAGAAACAGGAAGACAGGUAAU | 2857 | 1117-1139 |
| AD-292983.1 | ACCUGUCUUCCUGUUUCUCAA | 2563 | 1120-1140 | UUGAGAAACAGGAAGACAGGUAA | 2858 | 1118-1140 |
| AD-292984.1 | CCUGUCUUCCUGUUUCUCAAU | 2564 | 1121-1141 | ATUGAGAAACAGGAAGACAGGUA | 2859 | 1119-1141 |
| AD-293027.1 | GGUCUGUUUCCUUUCAUGU | 2565 | 1164-1184 | ACAUGAAAGGAAAAACAGACCUA | 2860 | 1162-1184 |
| AD-293028.1 | GUCUGUUUUCCUUUCAUGCU | 2566 | 1165-1185 | AGCATGAAAGGAAAAACAGACCU | 2861 | 1163-1185 |
| AD-293034.1 | UUUUCCUUCAUGCCUCUUAA | 2567 | 1171-1191 | UTAAGAGGCAUGAAAGGAAAAAC | 2862 | 1169-1191 |
| AD-293037.1 | UCCUUUCATGCCUCUUAAAAA | 2568 | 1174-1194 | UTUUTAAGAGGCATGAAAGGAAA | 2863 | 1172-1194 |
| AD-293039.1 | CUUUCAUGCCUCUUAAAAACU | 2569 | 1176-1196 | AGUUUTAAGAGGCAUGAAAGGA | 2864 | 1174-1196 |
| AD-293099.1 | UUUUUCCATUTAAAGGUGGAU | 2570 | 1245-1265 | ATCCACCUUUAAAUGGAAAAAUA | 2865 | 1243-1265 |
| AD-293153.1 | AACUAAUUACACAGGGAAGU | 2571 | 1299-1319 | ACUUCCCUGUGTAAAUAAGUUCU | 2866 | 1297-1319 |
| AD-293156.1 | UUAUUACACAGGGAAGGUUU | 2572 | 1302-1322 | AAACCUCCCUGUGUAAAUAAGU | 2867 | 1300-1322 |
| AD-293162.1 | ACACAGGGAAGGUUUAAGACU | 2573 | 1308-1328 | AGUCUUAAACCUCCCUGUGUAA | 2868 | 1306-1328 |
| AD-293163.1 | CACAGGGAAGGUUUAAGACUU | 2574 | 1309-1329 | AAGUCUUAAACCUCCCUGUGUA | 2869 | 1307-1329 |
| AD-293166.1 | AGGGAAGGTUAAGACUGUUU | 2575 | 1312-1332 | AAACAGTCUUAAACCUUCCCUGU | 2870 | 1310-1332 |
| AD-293167.1 | GGGAAGGUUAAGACUGUUCA | 2576 | 1313-1333 | UGAACAGUCUUAAACCUUCCCUG | 2871 | 1311-1333 |
| AD-293168.1 | GGAAGGUUAAGACUGUUCAA | 2577 | 1314-1334 | UTGAACAGUCUAAACCUUCCCU | 2872 | 1312-1334 |
| AD-293169.1 | GAAGGUUAAGACUGUUCAAG | 2578 | 1315-1335 | ATUGAACAGCUUAAACCUUCCC | 2873 | 1313-1335 |
| AD-293170.1 | AAGGUUUAAGACUGUUCAAGU | 2579 | 1316-1336 | ACUUGAACAGUCUAAACCUUCC | 2874 | 1314-1336 |
| AD-293171.1 | AGGUUUAAGACUGUUCAAGUA | 2580 | 1317-1337 | UACUGAACAGTCTAAACCUUC | 2875 | 1315-1337 |
| AD-293172.1 | GGUUUAAGACTGUUCAAGUAU | 2581 | 1318-1338 | ATACTGAACAGUCUUAAACCUU | 2876 | 1316-1338 |
| AD-293174.1 | UUUAAGACTGTUCAAGUAGCA | 2582 | 1320-1340 | UGCUACUUGAACAGUCUUAAACC | 2877 | 1318-1340 |
| AD-293177.1 | AAGACUGUCAAGUAGCAUUU | 2584 | 1323-1343 | AAAUGCUACUUGAACAGUCUUAA | 2879 | 1321-1343 |
| AD-293178.1 | AGACUGUUCAAGUAGCAUUCU | 2585 | 1324-1344 | AGAATGCUACUGAACAGUCUUA | 2880 | 1322-1344 |
| AD-293179.1 | GACUGUUCAAGUAGCAUUCCA | 2586 | 1325-1345 | UGGAAUGCUACUUGAACAGUCUU | 2881 | 1323-1345 |
| AD-293180.1 | ACUGUUCAAGTAGCAUUCCAA | 2587 | 1326-1346 | UTGGAATGCUACUGAACAGUCU | 2882 | 1324-1346 |
| AD-293181.1 | CUGUUCAAGUAGCAUUCCAAU | 2588 | 1327-1347 | ATUGGAAUGCUACUGAACAGUC | 2883 | 1325-1347 |

TABLE 11-continued

HSD17B13 NonF DNA Unmodified Sequence*

| Duplex Name | Sense sequence 5' to 3' | SEQ ID NO: | Position in NM_178135.4 | Antisense sequence 5' to 3' | SEQ ID NO: | Range in NM_178135.4 |
|---|---|---|---|---|---|---|
| AD-293182.1 | UGUUCAAGUAGCAUUCCAAUU | 2589 | 1328-1348 | AAUUGGAAUGCUACUUGAACAGU | 2884 | 1326-1348 |
| AD-293183.1 | GUUCAAGUAGCAUUCCAAUCU | 2590 | 1329-1349 | AGAUUGGAAUGCUACUUGAACAG | 2885 | 1327-1349 |
| AD-293184.1 | UUCAAGUAGCAUUCCAAUCUU | 2591 | 1330-1350 | AAGAUUGGAAUGCUACUUGAACA | 2886 | 1328-1350 |
| AD-293186.1 | CAAGUAGCAUUCCAAUCUGUA | 2592 | 1332-1352 | UACAGAUUGGAAUGCUACUUGAA | 2887 | 1330-1352 |
| AD-293187.1 | AAGUAGCAUUCCAAUCUGUAU | 2593 | 1333-1353 | AUACAGAUUGGAAUGCUACUUGA | 2888 | 1331-1353 |
| AD-293191.1 | AGCAUUCCAAUCUGUAGCCAU | 2594 | 1337-1357 | AUGGCUACAGAUUGGAAUGCUAC | 2889 | 1335-1357 |
| AD-293218.1 | GAAUAUCAACAAGAACACAGA | 2595 | 1364-1384 | UCUGUGUUCUUGUUGAUAUUCUG | 2890 | 1362-1384 |
| AD-293228.1 | AAGAACACAGAAUGAGUGCAU | 2596 | 1374-1394 | AUGCACUCAUUCUGUGUUCUUGU | 2891 | 1372-1394 |
| AD-293230.1 | GAACACAGAAUGAGUGCACAU | 2597 | 1376-1396 | AUGUGCACUCAUUCUGUGUUCUU | 2892 | 1374-1396 |
| AD-293231.1 | AACACAGAAUGAGUGCACAGU | 2598 | 1377-1397 | ACUGUGCACUCAUUCUGUGUUCU | 2893 | 1375-1397 |
| AD-293235.1 | CAGAAUGAGUGCACAGCUAAU | 2599 | 1381-1401 | AUUAGCUGUGCACUCAUUCUGUG | 2894 | 1379-1401 |
| AD-293271.1 | AGGCAGCUUAUCUCAACCUU | 2600 | 1417-1437 | AAGGUUGAGAUAAAGCUGCCUGC | 2895 | 1415-1437 |
| AD-293273.1 | GCAGCUUUAUCUCAACCUGGA | 2601 | 1419-1439 | UCCAGGUUGAGAUAAAGCUGCCU | 2896 | 1417-1439 |
| AD-293306.1 | UUCAGCAUUUGAAAGAUUUCU | 2602 | 1452-1472 | AGAAAUCUUUCAAAUGCUGAAUC | 2897 | 1450-1472 |
| AD-293309.1 | AGCAUUUGAAAGAUUUCCCUA | 2603 | 1455-1475 | UAGGGAAAUCUUUCAAAUGCUGA | 2898 | 1453-1475 |
| AD-293311.1 | CAUUUGAAAGAUUUCCCUAGU | 2604 | 1457-1477 | ACUAGGGAAAUCUUUCAAAUGCU | 2899 | 1455-1477 |
| AD-293312.1 | AUUUGAAAGAUUUCCCUAGCU | 2605 | 1458-1478 | AGCUAGGGAAAUCUUUCAAAUGC | 2900 | 1456-1478 |
| AD-293315.1 | UGAAAGAUUUCCCUAGCCUCU | 2606 | 1461-1481 | AGAGGCUAGGGAAAUCUUUCAAA | 2901 | 1459-1481 |
| AD-293323.1 | UUCCCUAGCCUCUUCCUUUUU | 2608 | 1469-1489 | AAAAAGGAAGAGGCUAGGGAAAU | 2903 | 1467-1489 |
| AD-293353.1 | AAAACGGUGCAACUCUAUUCU | 2609 | 1499-1519 | AGAAUAGAGUUGCACCGUUUUGG | 2904 | 1497-1519 |
| AD-293354.1 | AAACGGUGCAACUCUAUUCUU | 2610 | 1500-1520 | AAGAAUAGAGUGCACCGUUUUG | 2905 | 1498-1520 |
| AD-293355.1 | AACGGUGCAACUCUAUUCUGU | 2611 | 1501-1521 | ACAGAAUAGAGUUGCACCGUUUU | 2906 | 1499-1521 |
| AD-293359.1 | GUGCAACUCUAUUCUGGACUU | 2613 | 1505-1525 | AAGUCCAGAAUAGAGUUGCACCG | 2908 | 1503-1525 |
| AD-293360.1 | UGCAACUCUAUCUGGACUUU | 2614 | 1506-1526 | AAAGUCCAGAAUAGAGUUGCACC | 2909 | 1504-1526 |
| AD-293361.1 | GCAACUCUAUCUGGACUUUA | 2615 | 1507-1527 | UAAAGUCCAGAAUAGAGUUGCAC | 2910 | 1505-1527 |
| AD-293362.1 | CAACUCUAUCUGGACUUUAU | 2616 | 1508-1528 | AUAAAGUCCAGAAUAGAGUUGCA | 2911 | 1506-1528 |
| AD-293364.1 | ACUCUAUUCUGGACUUUAUUA | 2618 | 1510-1530 | UAAUAAAGUCCAGAAUAGAGUUG | 2913 | 1508-1530 |
| AD-293365.1 | CUCUAUUCUGGACUUUAUUAU | 2619 | 1511-1531 | AUAAUAAAGUCCAGAAUAGAGUU | 2914 | 1509-1531 |
| AD-293368.1 | UAUUCUGGACUUUAUUACUUU | 2620 | 1514-1534 | AAAGUAAUAAAGUCCAGAAUAGA | 2915 | 1512-1534 |
| AD-293369.1 | AUUCUGGACUUAUUACUUGA | 2621 | 1515-1535 | UCAAGUAAUAAAGUCCAGAAUAG | 2916 | 1513-1535 |
| AD-293370.1 | UUCUGGACUUAUUACUUGAU | 2622 | 1516-1536 | AUCAAGUAAUAAAGUCCAGAAUA | 2917 | 1514-1536 |
| AD-293410.1 | UGAAGUCCACCAAAAGUGGAU | 2623 | 1556-1576 | AUCCACUUUUGGUGGACUUCAGA | 2918 | 1554-1576 |
| AD-293419.1 | CCAAAAGUGGACCCUCUAUAU | 2624 | 1565-1585 | AUAUAGAGGGUCCACUUUUGGUG | 2919 | 1563-1585 |
| AD-293420.1 | CAAAAGUGGACCCUCUAUAUU | 2625 | 1566-1586 | AAUAUAGAGGGUCCACUUUUGGU | 2920 | 1564-1586 |
| AD-293422.1 | AAAGUGGACCCUCUAUAUUUC | 2626 | 1568-1588 | GAAAUAUAGAGGGUCCACUUUUG | 2921 | 1566-1588 |
| AD-293423.1 | AAGUGGACCCUCUAUAUUUCU | 2627 | 1569-1589 | AGAAAUAUAGAGGGUCCACUUUU | 2922 | 1567-1589 |
| AD-293530.1 | CUUUCAUAUAUCCUUGGUCCU | 2628 | 1699-1719 | AGGACCAAGGAUAUAUGAAAGCA | 2923 | 1697-1719 |
| AD-293532.1 | UUCAUAUAUCCUUGGUCCCAU | 2629 | 1701-1721 | AUGGGACCAAGGAUAUAUGAAAG | 2924 | 1699-1721 |
| AD-293554.1 | GAUGUUUAGACAAUUUUAGGU | 2630 | 1723-1743 | ACCUAAAAUUGUCUAAACAUCUC | 2925 | 1721-1743 |
| AD-293555.1 | AUGUUUAGACAAUUUUAGGCU | 2631 | 1724-1744 | AGCCUAAAAUUGUCUAAACAUCU | 2926 | 1722-1744 |
| AD-293557.1 | GUUUAGACAAUUUUAGGCUCA | 2632 | 1726-1746 | UGAGCCUAAAAUUGUCUAAACAU | 2927 | 1724-1746 |
| AD-293558.1 | UUUAGACAAUUUUAGGCUCAA | 2633 | 1727-1747 | UUGAGCCUAAAAUUGUCUAAACA | 2928 | 1725-1747 |
| AD-293559.1 | UUAGACAAUUUAGGCUCAAA | 2634 | 1728-1748 | UUUGAGCCUAAAAUUGUCUAAAC | 2929 | 1726-1748 |
| AD-293560.1 | UAGACAAUUUAGGCUCAAAA | 2635 | 1729-1749 | UUUUGAGCCUAAAAUUGUCUAAA | 2930 | 1727-1749 |
| AD-293562.1 | GACAAUUUAGGCUCAAAAAU | 2636 | 1731-1751 | AUUUUGAGCCUAAAAUUGUCUA | 2931 | 1729-1751 |
| AD-293569.1 | UUAGGCUCAAAAAUUAAAGCU | 2637 | 1738-1758 | AGCUUAAUUUUGAGCCUAAAA | 2932 | 1736-1758 |
| AD-293570.1 | UAGGCUCAAAAAUUAAAGCUA | 2638 | 1739-1759 | UAGCUUAAUUUUGAGCCUAAAA | 2933 | 1737-1759 |
| AD-293571.1 | AGGCUCAAAAAUUAAAGCUAA | 2639 | 1740-1760 | UUAGCUUAAUUUUGAGCCUAAA | 2934 | 1738-1760 |
| AD-293572.1 | GGCUCAAAAAUUAAAGCUAAU | 2640 | 1741-1761 | AUUAGCUUAAUUUUGAGCCUAA | 2935 | 1739-1761 |
| AD-293573.1 | GCUCAAAAAUAAAGCUAACA | 2641 | 1742-1762 | UGUUAGCUUUAAUUUUGAGCCU | 2936 | 1740-1762 |
| AD-293574.1 | CUCAAAAAUAAAGCUAACAU | 2642 | 1743-1763 | AUGUUAGCUUUAAUUUUGAGCC | 2937 | 1741-1763 |
| AD-293575.1 | UCAAAAAUAAAGCUAACACA | 2643 | 1744-1764 | UGUGUUAGCUUUAAUUUUGAG | 2938 | 1742-1764 |
| AD-293576.1 | CAAAAAUAAAGCUAACACAU | 2644 | 1745-1765 | AUGUGUUAGCUUAAUUUUGAG | 2939 | 1743-1765 |
| AD-293579.1 | AAAUUAAAGCUAACACAGGAA | 2645 | 1748-1768 | UCCUGUGUUAGCUUAAUUUUU | 2940 | 1746-1768 |
| AD-293586.1 | AGCUAACACAGGAAAAGGAAU | 2646 | 1755-1775 | AUCCUUUCCUGUGUUAGCUUU | 2941 | 1753-1775 |
| AD-293589.1 | UAACACAGGAAAAGGAACUGU | 2647 | 1758-1778 | ACAGUUCCUUUCCUGUGUUAGC | 2942 | 1756-1778 |
| AD-293592.1 | CACAGGAAAAGGAACUGUACU | 2648 | 1761-1781 | AGUACAGUUCCUUUCCUGUGUU | 2943 | 1759-1781 |
| AD-293594.1 | CAGGAAAAGGAACUGUACUGU | 2649 | 1763-1783 | ACAGUACAGUUCCUUUCCUGUG | 2944 | 1761-1783 |
| AD-293601.1 | AGGAACUGUACUGGCUAUUAU | 2650 | 1770-1790 | AUAAUAGCCAGUACAGUUCCUUU | 2945 | 1768-1790 |
| AD-293872.1 | CGACUCCCACUACAUCAAGAU | 2652 | 2186-2206 | AUCUUGAUGUAGUGGGAGUCGGA | 2947 | 2184-2206 |
| AD-293875.1 | CUCCCACUACAUCAAGACUAA | 2653 | 2189-2209 | UUAGUCUUGAUGUAGUGGGAGUC | 2948 | 2187-2209 |
| AD-293876.1 | UCCCACUACAUCAAGACUAAU | 2654 | 2190-2210 | AUUAGUCUUGAUGUAGUGGGAGU | 2949 | 2188-2210 |
| AD-293877.1 | CCCACUACAUCAAGACUAAUU | 2655 | 2191-2211 | AAUUAGUCUUGAUGUAGUGGGAG | 2950 | 2189-2211 |
| AD-293878.1 | CCACUACAUCAAGACUAAUCU | 2656 | 2192-2212 | AGAUUAGUCUUGAUGUAGUGGGA | 2951 | 2190-2212 |
| AD-293879.1 | CACUACAUCAAGACUAAUCUU | 2657 | 2193-2213 | AAGAUUAGUCUUGAUGUAGUGG | 2952 | 2191-2213 |
| AD-293880.1 | ACUACAUCAAGACUAAUCUUU | 2658 | 2194-2214 | AAAGAUUAGUCUUGAUGUAGUGG | 2953 | 2192-2214 |
| AD-293881.1 | CUACAUCAAGACUAAUCUUGU | 2659 | 2195-2215 | ACAAGAUUAGUCUUGAUGUAGUG | 2954 | 2193-2215 |
| AD-293882.1 | UACAUCAAGACUAAUCUUGUU | 2660 | 2196-2216 | AACAAGAUUAGUCUUGAUGUAGU | 2955 | 2194-2216 |
| AD-293898.1 | UUGUGUGUUUCACAUGUAU | 2662 | 2217-2237 | AUACAUGUGAAAAACACAGAA | 2957 | 2215-2237 |
| AD-293902.1 | GUGUUUUCACAUGUAUUAUA | 2663 | 2221-2241 | UAUAAUACAUGUGAAAAACACAC | 2958 | 2219-2241 |
| AD-293909.1 | UCACAUGUAUUAUAGAAUGCU | 2664 | 2228-2248 | AGCAUUCUAUAAUACAUGUGAAA | 2959 | 2226-2248 |
| AD-293910.1 | CACAUGUAUAUAGAAUGCUU | 2665 | 2229-2249 | AAGCAUUCUAUAAUACAUGUGAA | 2960 | 2227-2249 |
| AD-293914.1 | UGUAUUAUAGAAUGCUUUUGU | 2666 | 2233-2253 | ACAAAAGCAUUCUAUAAUACAUG | 2961 | 2231-2253 |
| AD-293915.1 | GUAUUAUAGAAUGCUUUUGCA | 2667 | 2234-2254 | UGCAAAAGCAUUCUAUAAUACAU | 2962 | 2232-2254 |

TABLE 11-continued

HSD17B13 NonF DNA Unmodified Sequence*

| Duplex Name | Sense sequence 5' to 3' | SEQ ID NO: | Position in NM_178135.4 | Antisense sequence 5' to 3' | SEQ ID NO: | Range in NM_178135.4 |
|---|---|---|---|---|---|---|
| AD-293919.1 | UAUAGAAUGCUUUUGCAUGGA | 2668 | 2238-2258 | UCCAUGCAAAAGCAUUCUAUAAU | 2963 | 2236-2258 |
| AD-293923.1 | GAAUGCUUUGCAUGGACUAU | 2670 | 2242-2262 | AUAGUCCAUGCAAAAGCAUUCUA | 2965 | 2240-2262 |
| AD-293925.1 | AUGCUUUUGCAUGGACUAUCU | 2671 | 2244-2264 | AGAUAGUCCAUGCAAAAGCAUUC | 2966 | 2242-2264 |
| AD-293928.1 | CUUUUGCAUGGACUAUCCUCU | 2672 | 2247-2267 | AGAGGAUAGUCCAUGCAAAAGCA | 2967 | 2245-2267 |
| AD-293931.1 | UUGCAUGGACUAUCCUCUUGU | 2673 | 2250-2270 | ACAAGAGGAUAGUCCAUGCAAAA | 2968 | 2248-2270 |
| AD-293932.1 | UGCAUGGACUAUCCUCUUGUU | 2674 | 2251-2271 | AACAAGAGGAUAGUCCAUGCAAA | 2969 | 2249-2271 |
| AD-293933.1 | GCAUGGACUAUCCUCUUGUUU | 2675 | 2252-2272 | AAACAAGAGGAUAGUCCAUGCAA | 2970 | 2250-2272 |
| AD-293934.1 | CAUGGACUAUCCUCUUGUUUU | 2676 | 2253-2273 | AAAACAAGAGGAUAGUCCAUGCA | 2971 | 2251-2273 |
| AD-293935.1 | AUGGACUAUCCUCUUGUUUUU | 2677 | 2254-2274 | AAAAACAAGAGGAUAGUCCAUGC | 2972 | 2252-2274 |
| AD-293936.1 | UGGACUAUCCUCUUGUUUUUA | 2678 | 2255-2275 | UAAAAACAAGAGGAUAGUCCAUG | 2973 | 2253-2275 |
| AD-293937.1 | GGACUAUCCUCUUGUUUUUAU | 2679 | 2256-2276 | AUAAAAACAAGAGGAUAGUCCAU | 2974 | 2254-2276 |
| AD-293938.1 | GACUAUCCUCUUGUUUUUAUU | 2680 | 2257-2277 | AAUAAAAACAAGAGGAUAGUCCA | 2975 | 2255-2277 |
| AD-293940.1 | CUAUCCUCUGUUUUUAUUAA | 2681 | 2259-2279 | UUAAUAAAAACAAGAGGAUAGUC | 2976 | 2257-2279 |

*Target: HSD17B13

TABLE 12

HSD17B13 NonF DNA in vitro 10 nM screen in Cos-7 (Human Dual-Luciferase psiCHECK2 vector) and Primary Cynomolgus Hepatocytes

| Duplex Name | % of Human Message Remaining 10 nM | % of Human Message Remaining 0.1 nM | % of Cyno Message remaining 10 nM | % of Cyno Message remaining 0.1 nM |
|---|---|---|---|---|
| AD-291929.1 | 71.9 | 80.9 | 83.6 | 83.4 |
| AD-291931.1 | 110.8 | 84.8 | 100.1 | 97.8 |
| AD-291988.1 | 78.0 | 104.0 | 65.3 | 97.3 |
| AD-291993.1 | 102.1 | 100.5 | 78.9 | 69.1 |
| AD-291998.1 | 81.6 | 97.4 | 26.3 | 60.9 |
| AD-292005.1 | 101.3 | 93.7 | 69.2 | 74.9 |
| AD-292006.1 | 45.7 | 93.2 | 58.7 | 81.7 |
| AD-292007.1 | 130.7 | 101.5 | 62.4 | 100.0 |
| AD-292008.1 | 99.4 | 102.4 | 63.7 | 91.3 |
| AD-292010.1 | 72.6 | 87.1 | 49.5 | 95.8 |
| AD-292012.1 | 79.5 | 83.6 | 86.8 | 86.3 |
| AD-292013.1 | 61.3 | 94.1 | 45.2 | 83.9 |
| AD-292014.1 | 50.0 | 87.4 | 40.0 | 40.1 |
| AD-292015.1 | 44.9 | 88.2 | 31.6 | 78.8 |
| AD-292016.1 | 52.6 | 84.2 | 48.2 | 90.8 |
| AD-292017.1 | 43.8 | 86.8 | 54.8 | 96.7 |
| AD-292028.1 | 77.4 | 88.2 | 107.2 | 91.5 |
| AD-292137.1 | 96.9 | 83.6 | 105.7 | 103.9 |
| AD-292140.1 | 30.6 | 95.0 | 26.3 | 59.0 |
| AD-292143.1 | 38.4 | 79.3 | 33.9 | 85.3 |
| AD-292182.1 | 127.2 | 99.8 | 91.8 | 71.1 |
| AD-292183.1 | 95.2 | 91.8 | 102.5 | 87.6 |
| AD-292185.1 | 50.6 | 91.7 | 74.5 | 93.3 |
| AD-292186.1 | 48.6 | 95.0 | 81.3 | 85.6 |
| AD-292187.1 | 90.1 | 89.5 | 82.7 | 95.5 |
| AD-292188.1 | 53.1 | 99.0 | 42.5 | 81.8 |
| AD-292189.1 | 103.9 | 78.7 | 73.2 | 104.0 |
| AD-292190.1 | 67.5 | 81.6 | 105.5 | 81.9 |
| AD-292238.1 | 40.6 | 86.1 | 71.7 | 86.8 |
| AD-292244.1 | 92.8 | 78.7 | 116.0 | 91.8 |
| AD-292245.1 | 62.2 | 75.2 | 55.5 | 97.0 |
| AD-292247.1 | 51.0 | 84.4 | 63.4 | 87.5 |
| AD-292248.1 | 77.4 | 104.3 | 51.0 | 94.8 |
| AD-292250.1 | 31.0 | 85.4 | 44.9 | 92.2 |
| AD-292251.1 | 45.7 | 91.0 | 74.1 | 90.6 |
| AD-292252.1 | 60.0 | 83.4 | 88.6 | 102.1 |
| AD-292255.1 | 29.1 | 121.4 | 35.3 | 75.7 |
| AD-292254.1 | 50.1 | 94.7 | 32.3 | 62.3 |
| AD-292257.1 | 54.9 | 96.3 | 57.6 | 84.8 |
| AD-292309.1 | 93.2 | 108.1 | 93.4 | 87.1 |
| AD-292310.1 | 94.4 | 101.0 | 87.9 | 101.6 |
| AD-292315.1 | 86.1 | 88.8 | 62.9 | 90.8 |
| AD-292318.1 | 67.1 | 105.0 | 85.3 | 85.5 |
| AD-292344.1 | 36.1 | 91.7 | 33.0 | 53.0 |
| AD-292345.1 | 68.5 | 88.1 | 81.9 | 106.0 |
| AD-292346.1 | 38.8 | 80.4 | 63.7 | 66.2 |
| AD-292363.1 | 85.2 | 76.8 | 96.0 | 101.8 |
| AD-292366.1 | 75.3 | 82.9 | 100.2 | 107.5 |
| AD-292367.1 | 86.9 | 70.2 | 97.0 | 113.8 |
| AD-292369.1 | 96.6 | 88.6 | 91.3 | 91.6 |
| AD-292370.1 | 44.8 | 84.8 | 59.7 | 88.9 |
| AD-292371.1 | 47.1 | 76.8 | 78.3 | 96.3 |
| AD-292373.1 | 83.4 | 79.9 | 32.3 | 128.5 |
| AD-292374.1 | 126.7 | 92.9 | 78.8 | 98.5 |
| AD-292376.1 | 63.8 | 89.3 | 73.9 | 87.3 |
| AD-292377.1 | 47.5 | 79.9 | 49.7 | 77.6 |
| AD-292379.1 | 92.9 | 99.8 | 99.0 | 86.5 |
| AD-292380.1 | 69.1 | 82.6 | 46.5 | 70.2 |
| AD-292381.1 | 30.1 | 73.4 | 58.1 | 95.4 |
| AD-292382.1 | 42.1 | 86.7 | 87.3 | 97.4 |
| AD-292383.1 | 18.7 | 69.7 | 47.1 | 41.7 |
| AD-292384.1 | 27.4 | 83.2 | 36.6 | 83.8 |
| AD-292385.1 | 59.5 | 107.0 | 51.1 | 115.1 |
| AD-292388.1 | 33.9 | 80.2 | 37.4 | 51.4 |
| AD-292389.1 | 54.9 | 90.8 | 79.0 | 92.4 |
| AD-292390.1 | 43.4 | 81.4 | 49.8 | 82.4 |
| AD-292394.1 | 20.8 | 74.8 | 56.3 | 57.0 |
| AD-292397.1 | 87.6 | 80.3 | 56.8 | 79.6 |
| AD-292398.1 | 25.3 | 84.3 | 21.9 | 56.5 |
| AD-292399.1 | 43.1 | 84.4 | 26.6 | 61.1 |
| AD-292403.1 | 75.2 | 91.7 | 19.6 | 59.7 |
| AD-292404.1 | 99.9 | 89.7 | 68.5 | 70.8 |
| AD-292405.1 | 65.8 | 93.2 | 39.0 | 49.5 |
| AD-292406.1 | 77.3 | 70.4 | 89.7 | 96.8 |
| AD-292407.1 | 47.4 | 91.5 | 64.1 | 50.3 |
| AD-292408.1 | 67.3 | 102.5 | 72.1 | 89.8 |
| AD-292409.1 | 47.3 | 84.2 | 88.6 | 91.7 |
| AD-292410.1 | 90.3 | 89.2 | 50.5 | 94.3 |
| AD-292434.1 | 109.2 | 85.6 | 97.7 | 118.1 |
| AD-292486.1 | 87.6 | 93.4 | 81.4 | 70.9 |
| AD-292487.1 | 71.1 | 91.4 | 83.5 | 101.3 |
| AD-292492.1 | 55.7 | 89.0 | 83.1 | 104.7 |
| AD-292495.1 | 74.2 | 87.6 | 39.8 | 89.4 |
| AD-292498.1 | 59.5 | 94.1 | 48.3 | 102.0 |
| AD-292499.1 | 40.6 | 95.4 | 36.7 | 69.9 |
| AD-292526.1 | 82.6 | 90.8 | 66.4 | 71.7 |
| AD-292531.1 | 95.5 | 81.2 | 100.4 | 110.5 |
| AD-292534.1 | 78.2 | 88.3 | 60.2 | 76.1 |
| AD-292536.1 | 55.9 | 90.9 | 43.0 | 82.7 |
| AD-292541.1 | 88.3 | 74.4 | 27.8 | 41.9 |

TABLE 12-continued

HSD17B13 NonF DNA in vitro 10 nM screen in Cos-7 (Human Dual-Luciferase psiCHECK2 vector) and Primary Cynomolgus Hepatocytes

| Duplex Name | % of Human Message Remaining 10 nM | % of Human Message Remaining 0.1 nM | % of Cyno Message remaining 10 nM | % of Cyno Message remaining 0.1 nM |
| --- | --- | --- | --- | --- |
| AD-292566.1 | 19.9 | 72.5 | 13.2 | 52.6 |
| AD-292574.1 | 24.4 | 71.6 | 26.1 | 73.5 |
| AD-292575.1 | 65.6 | 81.9 | 77.2 | 81.2 |
| AD-292576.1 | 16.5 | 80.7 | 28.5 | 43.3 |
| AD-292577.1 | 43.3 | 95.8 | 25.8 | 68.5 |
| AD-292578.1 | 23.4 | 58.8 | 15.6 | 68.8 |
| AD-292579.1 | 39.4 | 80.5 | 18.5 | 81.3 |
| AD-292582.1 | 53.7 | 89.0 | 56.3 | 96.1 |
| AD-292596.1 | 71.7 | 90.7 | 34.6 | 78.4 |
| AD-292601.1 | 80.9 | 103.8 | 83.1 | 101.7 |
| AD-292606.1 | 72.8 | 93.1 | 71.1 | 110.5 |
| AD-292607.1 | 64.0 | 94.9 | 96.3 | 81.4 |
| AD-292610.1 | 76.6 | 83.1 | 88.3 | 90.3 |
| AD-292612.1 | 52.9 | 81.4 | 66.2 | 81.5 |
| AD-292613.1 | 27.9 | 79.6 | 53.3 | 96.2 |
| AD-292614.1 | 51.4 | 92.8 | 87.1 | 96.4 |
| AD-292615.1 | 75.1 | 88.2 | 92.9 | 108.1 |
| AD-292616.1 | 73.9 | 90.6 | 90.3 | 85.7 |
| AD-292621.1 | 54.2 | 97.1 | 59.3 | 99.4 |
| AD-292625.1 | 28.1 | 83.1 | 22.7 | 73.4 |
| AD-292629.1 | 25.7 | 80.1 | 49.1 | 63.6 |
| AD-292630.1 | 26.4 | 99.1 | 31.1 | 47.4 |
| AD-292631.1 | 53.9 | 70.9 | 84.9 | 103.8 |
| AD-292634.1 | 74.5 | 92.9 | 89.3 | 82.6 |
| AD-292638.1 | 50.1 | 88.5 | 74.8 | 79.7 |
| AD-292639.1 | 73.9 | 86.3 | 62.4 | 85.5 |
| AD-292640.1 | 17.0 | 71.2 | 49.7 | 48.3 |
| AD-292641.1 | 55.1 | 100.4 | 70.5 | 92.6 |
| AD-292642.1 | 29.7 | 93.0 | 50.8 | 81.0 |
| AD-292646.1 | 41.7 | 95.5 | 79.8 | 92.7 |
| AD-292650.1 | 85.5 | 84.2 | 104.5 | 95.4 |
| AD-292651.1 | 44.4 | 94.8 | 72.9 | 84.0 |
| AD-292652.1 | 78.7 | 85.1 | 73.9 | 97.5 |
| AD-292667.1 | 91.8 | 83.0 | 108.4 | 95.8 |
| AD-292668.1 | 24.5 | 61.0 | 95.9 | 83.9 |
| AD-292671.1 | 18.8 | 61.8 | 42.5 | 93.0 |
| AD-292673.1 | 41.0 | 77.7 | 35.8 | 79.4 |
| AD-292677.1 | 73.0 | 74.0 | 111.0 | 90.7 |
| AD-292678.1 | 60.3 | 90.4 | 56.9 | 95.8 |
| AD-292679.1 | 45.0 | 74.8 | 45.1 | 72.5 |
| AD-292680.1 | 42.9 | 89.4 | 22.9 | 44.0 |
| AD-292681.1 | 56.4 | 99.9 | 94.6 | 105.1 |
| AD-292682.1 | 63.9 | 84.7 | 64.0 | 64.5 |
| AD-292684.1 | 24.2 | 81.8 | 16.2 | 88.1 |
| AD-292685.1 | 55.6 | 89.3 | 40.6 | 81.3 |
| AD-292691.1 | 27.0 | 82.0 | 27.8 | 59.7 |
| AD-292692.1 | 56.9 | 76.9 | 57.8 | 85.9 |
| AD-292693.1 | 24.3 | 76.9 | 16.6 | 47.8 |
| AD-292694.1 | 26.5 | 84.2 | 61.0 | 91.0 |
| AD-292695.1 | 35.8 | 82.1 | 24.0 | 62.8 |
| AD-292696.1 | 32.5 | 87.4 | 27.5 | 60.8 |
| AD-292697.1 | 51.8 | 79.1 | 33.8 | 57.3 |
| AD-292725.1 | 49.1 | 61.8 | 101.5 | 90.3 |
| AD-292726.1 | 41.3 | 71.5 | 81.7 | 90.6 |
| AD-292727.1 | 64.4 | 82.9 | 78.5 | 96.0 |
| AD-292728.1 | 54.9 | 65.4 | 96.9 | 121.5 |
| AD-292757.1 | 38.0 | 71.0 | 53.7 | 72.0 |
| AD-292759.1 | 93.8 | 89.4 | 89.7 | 82.5 |
| AD-292761.1 | 47.1 | 97.8 | 29.0 | 84.6 |
| AD-292766.1 | 139.5 | 89.6 | 92.1 | 105.5 |
| AD-292787.1 | 57.9 | 77.4 | 79.6 | 95.3 |
| AD-292788.1 | 23.2 | 88.1 | 75.5 | 85.9 |
| AD-292789.1 | 14.8 | 78.8 | 47.7 | 73.0 |
| AD-292793.1 | 16.8 | 62.8 | 16.1 | 33.1 |
| AD-292795.1 | 14.3 | 57.5 | 53.5 | 43.0 |
| AD-292796.1 | 22.7 | 56.2 | 18.2 | 71.8 |
| AD-292797.1 | 5.6 | 28.2 | 10.4 | 17.0 |
| AD-292800.1 | 9.6 | 58.3 | 12.8 | 25.3 |
| AD-292802.1 | 13.0 | 70.4 | 18.8 | 60.5 |
| AD-292806.1 | 14.9 | 63.8 | 9.9 | 39.7 |
| AD-292808.1 | 76.4 | 90.2 | 64.5 | 85.2 |
| AD-292870.1 | 11.8 | 42.5 | 33.1 | 50.4 |
| AD-292893.1 | 19.5 | 60.5 | 126.3 | 95.7 |
| AD-292906.1 | 26.3 | 32.8 | 39.7 | 80.9 |
| AD-292915.1 | 19.4 | 49.0 | 41.4 | 38.1 |
| AD-292935.1 | 73.8 | 82.0 | 42.3 | 64.3 |
| AD-292936.1 | 60.6 | 74.3 | 51.1 | 53.1 |
| AD-292967.1 | 11.4 | 46.8 | 51.2 | 89.8 |
| AD-292970.1 | 17.0 | 58.6 | 48.2 | 87.4 |
| AD-292974.1 | 23.3 | 72.1 | 68.3 | 78.4 |
| AD-292975.1 | 22.3 | 80.7 | 52.6 | 79.2 |
| AD-292978.1 | 23.6 | 77.6 | 29.9 | 74.0 |
| AD-292979.1 | 50.5 | 84.9 | 54.2 | 97.1 |
| AD-292980.1 | 36.4 | 107.7 | 42.5 | 91.0 |
| AD-292981.1 | 67.7 | 79.8 | 76.1 | 107.9 |
| AD-292982.1 | 27.1 | 76.5 | 42.7 | 74.1 |
| AD-292983.1 | 21.5 | 71.3 | 39.1 | 77.3 |
| AD-292984.1 | 24.2 | 73.5 | 36.2 | 69.6 |
| AD-293027.1 | 37.3 | 82.5 | 41.7 | 86.2 |
| AD-293028.1 | 59.8 | 81.3 | 64.4 | 92.3 |
| AD-293034.1 | 30.5 | 89.4 | 40.2 | 54.5 |
| AD-293037.1 | 45.8 | 77.7 | 42.3 | 81.9 |
| AD-293039.1 | 25.3 | 76.7 | 37.8 | 49.6 |
| AD-293099.1 | 47.1 | 87.8 | 50.8 | 77.5 |
| AD-293153.1 | 71.0 | 85.3 | 75.2 | 104.1 |
| AD-293156.1 | 38.3 | 93.0 | 46.6 | 131.7 |
| AD-293162.1 | 53.5 | 82.3 | 65.5 | 99.4 |
| AD-293163.1 | 36.1 | 84.2 | 74.8 | 96.1 |
| AD-293166.1 | 55.4 | 86.7 | 56.3 | 79.2 |
| AD-293167.1 | 69.9 | 94.9 | 52.4 | 63.0 |
| AD-293168.1 | 68.5 | 77.5 | 62.5 | 74.1 |
| AD-293169.1 | 62.0 | 89.4 | 51.6 | 98.0 |
| AD-293170.1 | 27.7 | 93.7 | 39.6 | 64.8 |
| AD-293171.1 | 14.1 | 67.7 | 42.0 | 36.4 |
| AD-293172.1 | 63.2 | 82.8 | 64.9 | 88.2 |
| AD-293174.1 | 19.3 | 95.6 | 50.2 | 68.6 |
| AD-293176.1 | 20.5 | 63.7 | 36.4 | 40.1 |
| AD-293177.1 | 21.4 | 93.0 | 31.5 | 44.8 |
| AD-293178.1 | 24.3 | 73.6 | 70.8 | 75.4 |
| AD-293179.1 | 52.5 | 78.7 | 51.1 | 85.3 |
| AD-293180.1 | 34.0 | 91.7 | 60.7 | 71.5 |
| AD-293181.1 | 58.7 | 107.6 | 35.6 | 78.0 |
| AD-293182.1 | 16.9 | 60.5 | 39.5 | 45.0 |
| AD-293183.1 | 31.4 | 78.1 | 74.7 | 83.4 |
| AD-293184.1 | 25.6 | 58.7 | 59.7 | 50.9 |
| AD-293186.1 | 48.4 | 78.2 | 41.4 | 73.5 |
| AD-293187.1 | 41.7 | 78.8 | 50.4 | 84.9 |
| AD-293191.1 | 56.1 | 103.5 | 72.3 | 84.1 |
| AD-293218.1 | 36.6 | 67.3 | 44.9 | 69.3 |
| AD-293228.1 | 83.7 | 92.4 | 84.0 | 74.2 |
| AD-293230.1 | 76.4 | 95.3 | 76.2 | 67.1 |
| AD-293231.1 | 57.6 | 83.2 | 56.3 | 101.8 |
| AD-293235.1 | 56.7 | 97.6 | 99.6 | 86.3 |
| AD-293271.1 | 112.7 | 85.7 | 85.7 | 110.6 |
| AD-293273.1 | 60.2 | 92.6 | 38.6 | 89.9 |
| AD-293306.1 | 33.9 | 90.2 | 42.6 | 70.4 |
| AD-293309.1 | 28.6 | 68.9 | 33.4 | 58.9 |
| AD-293311.1 | 13.4 | 66.4 | 28.2 | 41.2 |
| AD-293312.1 | 21.7 | 88.7 | 46.9 | 92.5 |
| AD-293315.1 | 29.4 | 88.6 | 50.1 | 82.0 |
| AD-293316.1 | 32.7 | 75.3 | 40.2 | 67.0 |
| AD-293323.1 | 85.3 | 103.1 | 49.1 | 91.3 |
| AD-293353.1 | 64.0 | 76.6 | 83.0 | 84.7 |
| AD-293354.1 | 50.9 | 79.2 | 64.5 | 84.5 |
| AD-293355.1 | 78.0 | 110.8 | 76.0 | 88.7 |
| AD-293358.1 | 46.0 | 106.3 | 91.5 | 98.3 |
| AD-293359.1 | 77.0 | 73.5 | 74.2 | 82.4 |
| AD-293360.1 | 75.9 | 104.8 | 56.5 | 88.2 |
| AD-293361.1 | 73.4 | 87.3 | 72.7 | 86.0 |
| AD-293362.1 | 38.3 | 81.1 | 75.0 | 84.3 |
| AD-293363.1 | 35.2 | 72.6 | 78.9 | 79.4 |
| AD-293364.1 | 83.5 | 86.1 | 80.9 | 74.2 |

TABLE 12-continued

HSD17B13 NonF DNA in vitro 10 nM screen in Cos-7 (Human Dual-Luciferase psiCHECK2 vector) and Primary Cynomolgus Hepatocytes

| Duplex Name | % of Human Message Remaining 10 nM | % of Human Message Remaining 0.1 nM | % of Cyno Message remaining 10 nM | % of Cyno Message remaining 0.1 nM |
|---|---|---|---|---|
| AD-293365.1 | 55.0 | 88.5 | 69.3 | 114.8 |
| AD-293368.1 | 19.6 | 50.5 | 40.7 | 66.8 |
| AD-293369.1 | 14.3 | 63.5 | 38.5 | 63.5 |
| AD-293370.1 | 93.8 | 84.2 | 99.4 | 112.0 |
| AD-293410.1 | 99.6 | 81.5 | 111.6 | 112.2 |
| AD-293419.1 | 84.8 | 89.5 | 88.7 | 66.7 |
| AD-293420.1 | 65.4 | 89.3 | 72.7 | 75.8 |
| AD-293422.1 | 55.1 | 104.1 | 99.0 | 97.0 |
| AD-293423.1 | 58.8 | 75.0 | 82.0 | 101.6 |
| AD-293530.1 | 33.5 | 86.1 | 54.2 | 103.1 |
| AD-293532.1 | 42.7 | 95.8 | 84.4 | 91.4 |
| AD-293554.1 | 63.0 | 84.0 | 106.1 | 100.8 |
| AD-293555.1 | 49.0 | 87.7 | 85.4 | 110.5 |
| AD-293557.1 | 34.8 | 90.9 | 42.7 | 71.2 |
| AD-293558.1 | 34.0 | 63.5 | 56.9 | 62.9 |
| AD-293559.1 | 23.4 | 53.8 | 52.4 | 48.2 |
| AD-293560.1 | 23.8 | 75.6 | 45.8 | 46.4 |
| AD-293562.1 | 54.3 | 67.3 | 45.0 | 68.8 |
| AD-293569.1 | 54.2 | 99.4 | 144.4 | 123.6 |
| AD-293570.1 | 43.8 | 106.2 | 66.9 | 67.3 |
| AD-293571.1 | 17.8 | 67.2 | 45.3 | 58.4 |
| AD-293572.1 | 25.4 | 78.2 | 43.2 | 52.5 |
| AD-293573.1 | 33.1 | 88.7 | 43.2 | 61.4 |
| AD-293574.1 | 89.3 | 84.3 | 70.6 | 94.1 |
| AD-293575.1 | 50.3 | 80.2 | 50.3 | 73.4 |
| AD-293576.1 | 47.3 | 88.6 | 42.2 | 69.7 |
| AD-293579.1 | 37.0 | 88.6 | 43.0 | 78.7 |
| AD-293586.1 | 109.6 | 101.6 | 69.8 | 111.1 |
| AD-293589.1 | 66.1 | 82.7 | 86.4 | 104.3 |
| AD-293592.1 | 54.7 | 84.6 | 63.6 | 95.7 |
| AD-293594.1 | 41.8 | 82.8 | 53.7 | 80.9 |
| AD-293601.1 | 40.1 | 80.8 | 69.9 | 68.9 |
| AD-293602.1 | 78.8 | 77.2 | 75.2 | 72.3 |
| AD-293872.1 | 89.1 | 88.4 | 106.8 | 116.8 |
| AD-293875.1 | 74.4 | 78.5 | 78.7 | 84.3 |
| AD-293876.1 | 25.1 | 68.3 | 70.4 | 61.4 |
| AD-293877.1 | 26.8 | 77.7 | 35.9 | 50.4 |
| AD-293878.1 | 13.3 | 80.2 | 75.0 | 64.2 |
| AD-293879.1 | 34.1 | 59.4 | 45.2 | 54.3 |
| AD-293880.1 | 19.0 | 80.8 | 59.2 | 55.4 |
| AD-293881.1 | 16.3 | 78.2 | 38.7 | 49.0 |
| AD-293882.1 | 11.9 | 39.5 | 33.7 | 47.3 |
| AD-293883.1 | 8.9 | 58.7 | 50.9 | 34.1 |
| AD-293898.1 | 23.0 | 64.6 | 41.5 | 76.4 |
| AD-293902.1 | 16.0 | 53.9 | 43.3 | 56.9 |
| AD-293909.1 | 75.9 | 112.6 | 74.2 | 91.0 |
| AD-293910.1 | 32.6 | 89.6 | 54.3 | 79.9 |
| AD-293914.1 | 35.0 | 88.0 | 52.9 | 72.0 |
| AD-293915.1 | 22.7 | 87.0 | 39.4 | 82.5 |
| AD-293919.1 | 31.8 | 79.6 | 59.5 | 84.2 |
| AD-293922.1 | 53.2 | 96.2 | 37.0 | 65.9 |
| AD-293923.1 | 48.5 | 76.0 | 77.7 | 99.7 |
| AD-293925.1 | 31.1 | 81.9 | 53.0 | 87.7 |
| AD-293928.1 | 29.4 | 73.5 | 68.8 | 95.5 |
| AD-293931.1 | 27.5 | 85.4 | 52.5 | 79.1 |
| AD-293932.1 | 14.2 | 61.7 | 55.5 | 65.7 |
| AD-293933.1 | 49.1 | 80.3 | 42.1 | 74.9 |
| AD-293934.1 | 30.9 | 79.7 | 46.1 | 87.7 |
| AD-293935.1 | 48.7 | 79.1 | 68.3 | 70.8 |
| AD-293936.1 | 55.0 | 84.6 | 45.8 | 90.3 |
| AD-293937.1 | 29.6 | 80.1 | 58.5 | 83.9 |
| AD-293938.1 | 24.7 | 67.9 | 58.4 | 94.8 |
| AD-293940.1 | 17.7 | 61.9 | 51.9 | 69.0 |

Example 3: Identification of a Loss-of-Function Mutation that Protects Against NASH Non-alcoholic steatohepatitis (NASH) is a progressive disease characterized by hepatic fat build-up and inflammation that may lead to cirrhosis. NASH is predicted to be the major driver for liver transplantation by 2020. Liver-related mortality increases exponentially with fibrosis progression.

A splice variant (rs72613567:TA) in HSD17B13 results in an unstable and truncated protein with reduced enzymatic activity against steroid substrates and, thus, represents a loss-of function variant in HSD17B13. HSD17B13:rs72613567:TA was reproducibly associated with reduced serum alanine aminotransferase (ALT) and aspartate aminotransferase (AST) and as depicted in FIG. 1, this variant is associated with significantly reduced risk of alcoholic and nonalcoholic liver disease, cirrhosis and hepatocellular carcinoma in an allele dosage-dependent manner.

HSD17B13, expressed in hepatocytes, is, thus, an attractive target for the treatment of NASH and other chronic liver diseases using dsRNA agents that inhibit the expression of HSD17B13 and mimic the loss-of-function variant rs72613567:TA.

Example 4: In Vivo Efficacy of dsRNA Agents Targeting HSD17B13

Figure 2A:
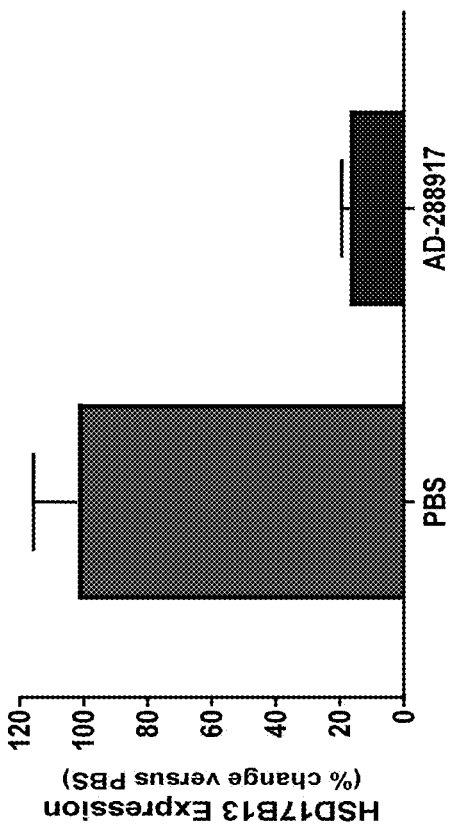
FIG. 2A is a graph depicting the effect of a single dose of AD-288917 in mice expressing human HSD17B13.

A. Human/NHP Cross-Reactive siRNA Efficacy Against Ectopically Expressed Human HSD17B13 in Mice Mice (n=3/group) were injected with an adeno-associated virus (AAV) expressing human HSD17B13. Fourteen days after AAV injection, mice were subcutaneously administered a single 3 mg/kg dose of AD-288917. Ten days after administration, human HSD17B13 expression in liver was determined by RT-qPCR and normalized against human HSD17B13 expression of control animals injected with PBS. As depicted in FIG. 2A, a single dose of AD-288917 effectively inhibits the expression of human HSD17B13.

Figure 2B:
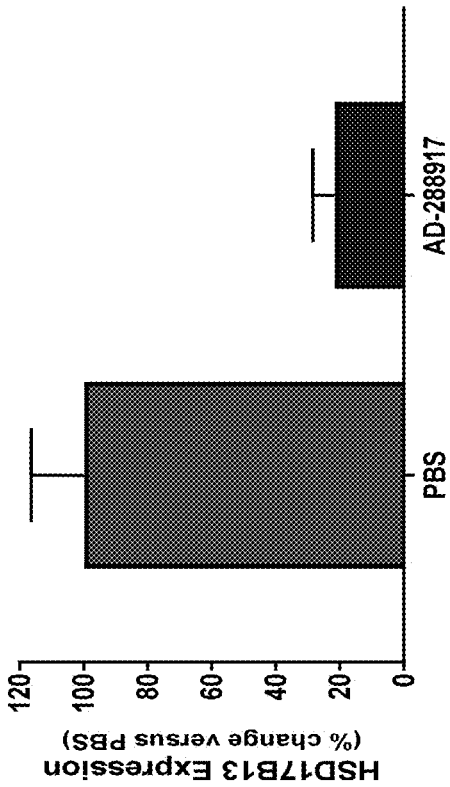
FIG. 2B is a graph depicting the effect of a single dose of AD-288917 in Cynomolgus monkeys.

B. Human/NHP Cross-Reactive siRNA Efficacy Against Endogenous HSD17B13 in Non-Human Primates Cynomolgus monkeys (n=3/group) were subcutaneously administered a single 3 mg/kg dose of AD-288917. Twenty-one days after duplex 1 administration, endogenous HSD17B13 expression was determined in liver biopsies by RT-qPCR and normalized against endogenous HSD17B13 expression of control animals injected with PBS. As depicted in FIG. 2B, a single dose of AD-288917 effectively inhibits the expression of endogenous HSD17B13.

Example 5: In Vivo Efficacy of dsRNA Agents Targeting HSD17B13

Cynomolgus monkeys (n=3/group) were subcutaneously administered a single 3 mg/kg dose or a single 10 mg/kg dose of an agent listed in Table 13. Twenty-one days after duplex administration, endogenous HSD17B13 expression was determined in liver biopsies (left and right lobes) by RT-qPCR and normalized against endogenous HSD17B13 expression of control animals injected with PBS. As shown in Table 14, a single 3 mg/kg or 10 mg/kg dose of all of the agents tested effectively inhibited the expression of endogenous HSD17B13.

TABLE 14

| Groups (n = 3/group) | 3 mg/kg | | | 10 mg/kg | | |
|---|---|---|---|---|---|---|
| | Left lobe | Right lobe | Average L + R | Left lobe | Right lobe | Average L + R |
| AD-288917 AVG | 0.58 | 0.58 | 0.58 | 0.25 | 0.26 | 0.25 |
| AD-288917 SEM | 0.26 | 0.26 | 0.26 | 0.01 | 0.05 | 0.03 |
| AD-288996 AVG | 0.28 | 0.18 | 0.23 | 0.11 | 0.11 | 0.11 |

TABLE 14-continued

| Groups (n = 3/group) | 3 mg/kg | | | 10 mg/kg | | |
|---|---|---|---|---|---|---|
| | Left lobe | Right lobe | Average L + R | Left lobe | Right lobe | Average L + R |
| AD-288996 SEM | 0.08 | 0.09 | 0.07 | 0.06 | 0.05 | 0.05 |
| AD-413639 AVG | 0.35 | 0.34 | 0.34 | 0.14 | 0.13 | 0.13 |
| AD-413639 SEM | 0.16 | 0.11 | 0.13 | 0.07 | 0.06 | 0.06 |
| AD-413644 AVG | 0.33 | 0.30 | 0.32 | 0.10 | 0.11 | 0.11 |
| AD-413644 SEM | 0.13 | 0.09 | 0.10 | 0.02 | 0.03 | 0.02 |
| AD-413669 AVG | 0.33 | 0.23 | 0.28 | 0.23 | 0.20 | 0.21 |
| AD-413669 SEM | 0.09 | 0.07 | 0.08 | 0.11 | 0.10 | 0.10 |
| PBS (control) AVG | 1.06 | 1.02 | 1.04 | | | |
| PBS (control) SEM | 0.26 | 0.20 | 0.23 | | | |

Results represent HSD17B13 expression (fold change versus PBS-control group)

TABLE 13

| Duplex ID | Strand | Modified Sequence (5'-3') | SEQ ID NO: | Unmodified Sequence (5'-3') | SEQ ID NO: |
|---|---|---|---|---|---|
| AD-288917 | sense | usascaucAfaGfAfCfuaaucuuguuL96 | 4486 | UACAUCAAGACUAAUCUUGUU | 4496 |
| | antisense | asAfscaag(Agn)uuagucUfuGfauguasgsu | 4487 | AACAAGAUUAGUCUUGAUGUAGU | 4497 |
| AD-288996 | sense | asusgcuuUfuGfCfAfuggacuaucuL96 | 4488 | AUGCUUUUGCAUGGACUAUCU | 4498 |
| | antisense | asGfsauag(Tgn)ccaugcAfaAfagcaususc | 4489 | AGAUAGTCCAUGCAAAAGCAUUC | 4499 |
| AD-413639 | sense | csgsuaugCfaGfAfAfuauucaauuuL96 | 4490 | CGUAUGCAGAAUAUUCAAUUU | 4500 |
| | antisense | asAfsauuGf(Agn)auauucUfgCfauacgsasu | 4491 | AAAUUGAAUAUUCUGCAUACGAU | 4501 |
| AD-413644 | sense | csgsuaugCfaGfAfAfuauucaauuuL96 | 4492 | CGUAUGCAGAAUAUUCAAUUU | 4502 |
| | antisense | asAfsaUfuGf(Agn)auauUfcUfgCfaUfaCfgsasu | 4493 | AAAUUGAAUAUUCUGCAUACGAU | 4503 |
| AD-413669 | sense | csusacauCfaAfGfAfcuaaucuuguL96 | 4494 | CUACAUCAAGACUAAUCUUGU | 4504 |
| | antisense | asCfsaaga(Tgn)uaguCfuUfgAfuguagsusg | 4495 | ACAAGAUAGUCUUGAUGUAGUG | 4505 |

SEQUENCE LISTING (4505 sequences)

SEQ ID NO: 1 - DNA, 2397 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 2 - DNA, 2289 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 3 - DNA, 1284 bp, Mus musculus
gcagcagcccataatacctgacagggctctctgtggagctctgagcagaggtgtctgttgtgagaacagagccatgaacctcatcctggaatttctccttctggtgggcgtcatcatctactcctacctggagtcactggtaaagttcttcattccccggagaaggaaatctgtgaccgggcagaccgttctcatcacgggggccggacacggaataggcaggctgactgcatatgaatttgcaaagcagaaaagcagactggttctatgggatatcaataagcgtggtgttgaggaaaccgcggacaaatgcaggaaactgggggccgtcgtgcacgtgtttgtggtggactgcagcaaccgggccgagatttacaactctgtggatcaggtaaagagagaagtaggtgatgtcgagatcgtggtaaacaacgccggggcgatatatccagcagaccttcttagtgccaaggacgaggagatcaccaagacctttgaggtcaatatcctcggacatttttggatcataaaagcactccttccatcgatgctgagaagaaactctggccacattgtcacagtggcttcggtgtgcggccatggagtgattccttatctcatcccttattgctccagcaagtttgctgctgtgggcttccaccgagcactgaccgcagaactggacaccttggggaaaaccggtatccaaacctcgtgtctctgccctgtgttcgtgaatactggcttcaccaaaaacccgagtacaaggttatggcctgtattagagccggaagaagttgcaaggagtctgatcaatggaatacttaccaacaagaaaatgatcttcgttccatcctatatcaatatttctctgatcctggaaaagtttcttcctgagcgtgccttaaaagcgatcagtcgtatacagaacattcaatttgaagcaattgtgggccacaaaaccaagatgaagtagtgcatgcagagacgtgtggacaccaatgatgtgaagccaagtttagaggggacacacagctttctttcacatgttttaagtgttccacatgtttaaaatgtaggcttgaccctagcagccatcgagtgcataagcgtggtcaactgtccttctagtttcctatacttatagatgtctcagctcctggtagtgggttctggcaatggatatgtaaaggagggaaaaggcaatccatgtgtttttataaaataaattactaaatagaaatgtgggcaaaagggcaagataataaagtcttgggcaaatgt

SEQ ID NO: 4 - DNA, 1730 bp, Mus musculus
gcagcagcccataatacctgacagggctctctgtggagctctgagcagaggtgtctgttgtgagaacagagccatgaacctcatcctggaatttctccttctggtgggcgtcatcatctactcctacctggagtcactggtaaagttcttcattccccggagaaggaaatctgtgaccgggcagaccgttctcatcacgggggccggacacggaataggcaggctgactgcatatgaatttgcaaagcagaaaagcagactggttctatgggatatcaataagcgtggtgttgaggaaaccgcggacaaatgcaggaaactgggggccgtcgtgcacgtgtttgtggtggactgcagcaaccgggccgagatttacaactctgtggatcaggtaaagagagaagtaggtgatgtcgagatcgtggtaaacaacgccggggcgatatatccagcagaccttcttagtgccaaggacgaggagatcaccaagacctttgaggtcaatatcctcggacatttttggatcataaaagcactccttccatcgatgctgagaagaaactctggccacattgtcacagtggcttcggtgtgcggccatggagtgattccttatctcatcccttattgctccagcaagtttgctgctgtgggcttccaccgagcactgaccgcagaactggacaccttggggaaaaccggtatccaaacctcgtgtctctgccctgtgttcgtgaatactggcttcaccaaaaacccgagtacaaggttatggcctgtattagagccggaagaagttgcaaggagtctgatcaatggaatacttaccaacaagaaaatgatcttcgttccatcctatatcaatatttctctgatcctggaaaaaggacctggattcagttccaagcacccacatggtggttctcaacagcctgttactccaatcccaggggatttgacaccctcttcagactttctcaaacactaggcactcgtggggtacgcatacgtcattcaggcaagccctcatacacataaaatagaataagcacatattttaaatgtgctactattactgatgttttaagccagttaaattatgtgattttcttaacagcaataaaatattgtagataatgtcatcatgctagctgcatcactctgactgtataaacccaagagaatttcactccatctccttctgccaaaatatttacaacacttaagaaataagggctgatttttattttttttaacataaaatatatgagacagttgtatcctgtcagctaaaaatgttttctctggcctgtgagttggctcagtagatgaagacacttgctgccaagcctaacaacctgaattcaactcccagaacccatgtaatgggaagacagatgggattcagagaaattgtcctctgatcattgtacccatgccttggtatatgagtatctgtgatggtttgtatatgctcagtccagggagtggcactactagaaggtgtggtcctgttggagtagatgtatcactgtgggtgtgggctttaataacctcatcctagctgcctggaagccagtattctgctagcagccttcatatgaagatacagaactctcagctgtgtttgcaccatgcctgcatgaacgctgccatgctcccaccttgatgataatggactgaacctctgaacctgtaagccagccccgattaaatgttgtcacttataa

SEQ ID NO: 5 - DNA, 1323 bp, Rattus norvegicus
tctctgtggagctccgtgcgggggcatctgctaggagaacagagtccaagggagagagcagctcagagccatgaacctcatcctggagcttctcttgctggtgggcatcatcatctactcctacctggagtcactggtaaagttcttcattccccagagaagaaagtctgtggccggacagactgttctcatcacaggagctggacacggaataggcaggctgacggcttatgaatttgcaaagcagaaaagcagattggtcctgtgggatattagtaagcacggtgttgaggaaaccgcagccaaatgcaggaaactgggggctgtcgtgcacgtgtttgtggtggactgcagcaaccgggcagagatttacaagtctgtggatcaggtaaagaaagaagttggtgacatagagattgtggtaaacaacgctggggcaatttatccagccgaccttcttagcaccaaggatgaggagatcaccaagaccttcgaggtcaacatcctaggacatttttggatcataaaagcactccttccatcgatgctgagaagaaactctggccacattgtcacagtggcttcagtgtgtggccacagagtgattccttatctcatcccatattgctccagcaagttcgctgctgtgggcttccacagagcactgactgcagaactggacaccttggggaaaaccggtatcaaaacctcctgtctctgccctgtgttcgtgaatactggcttcaccaaaaacccaagtaccaggttatggcctgtgttagagccggatgaagttgcaaggagtctgatcgatgggatacttaccaacaagaaaatgatcttcgttccgtcctatatcaatatctctctaatagtggaaatgttttttcctgaacgtgtcttaaaagctataaaccgtatacagaatattcagtttgaagcgattgtgggccacagaaccaagaggaagtaacatcttgcgtgcagagacgtgtggacgccaatgacgcgaagccaagtttagagcggacgcgaggctttctttcgcccgttttagaagtgttccttgtgtttaaaatgtaggtttggccctagtagccatcgagcaaacgagagtggtcaactgtccttctggtttcttatacttaaactctcagcccctggtattgggttctggaaatggagctgtagtaagacaatgcctgtcgcacagccgagtgaaaagtcatttggtgtgtttttactaaacagaaatgtgggagaaagggtaagacaataaaatcttggacaaatgctgaaaaaaaaaaaaaaaaaaaaaaaaaa

SEQ ID NO: 6 - DNA, 2529 bp, Macaca mulatta
cttcaaaaacctgaggtgtttccaacaccttaggacacgtgaacaaggcctgcttccaaagctggcttctatctggtagtcccattaacaccggggcacacctcttccctggagctctgtgtacagagtacctcctccctaggactatacaaggactgaaccagaaggaagaggacagggcagagccatgaacatcatcctggaaatccttctgcttctgatcaccatcatctactcctacttggagtcgttggtaaagtttttcattcctcggaggagaaaatctgtggctggggagattgttttcattactggagctgggcacggaataggcaggcggactgcctatgaatttgcaaaacaacagagcatactggttctgtgggatattaataagcgtggtgtggaggaaactgcagctgagtgccgaaaactaggcgtcactgcgcatgcgtacgtggtagactgcagcaacagagaagaaatctatcgctctctaaatcaggtgaagaaagaagtgggtgatgtgacaattgtggtgaataatgctgggacagtatatccagccgatcttcgcagcaccaaggatgaagagattaccaaaacatttgaggtcaacatcctaggacatttttggatcacaaaagcacttcttccatcgatgatagagagaaatcatggccacatcgtcacggtggcttcagtgtgtggccacgaagtgattccttacctcatcccttattgttccagcaaatttgctgctgttggctttcacagaggtctgacatcagaacttcaagctttgggaaaaactggtatcaaaacctcatgtctctgcccagtttttgtgaatactgggttcaccaaaaatccaagcacaagattatggcctgtattggagacagatgaagttgtaagaagtctgatagatggaatacttaccaataagaaaatgatttttgttccatcatatatcaatatctttctgatactaaagaagtttcttcctgaacgcgcctcagcatttttaaatcgtatgcagaatattcaatttgaagcagtggttggcaacaaaatcaaaatgaaatgaataaataagctctagccagcgttgtatgcatgataatgatattaatagtttagaatcaatgctgcaaagctttatttcacattttttcagtcctgttaatatgaaaaacattggtttggcactaacagcagtgaaatgatcaagattaattacctgtcttcctgtttctcaagaatattaatgtagtttttaataggtctgtttttcctttcatgcctcttaaaaacgtctgtgcttacataagcatacttaaaaggttttctttaagatattttatttttccatttaaaggtggacaaaactacctccctaagagtaaatacaaagatacttatttacacagggaaggtttaagactgttcaagtagcattccaatctgtagccacgccacggaatatcaacaagaacacagaatgagtgcacagctaagacaacaagcttcagcaagcagctttatctcaacctggacagactttaagattcagcatttgaaagatttccctagcctcttcctttttcatcagcctgaaacggtgcaactctattctggactttattacttgaatctgtcttctgtataactcttaagtccaccaaaagtggaccctctatatttcctccctttttataatcttataagatacattacgaaaggtgaccgactgtattttaaatctgagaattttaagttctagtcccatgataacctctttctttgtagtttatgcttacatatatccttggtcccagagctgtttagacaattttaggctcaaaaattaaagctaacacaggaaaaggaactgtactggctattacgtaactaacaatggatccaagagaaggaagggaagaaagaaaaggtttttttggtttttgttgttttttgttttttgttttttgtttgtttggttggtttgagatggagtctcgctctgtctcccaggctggagtgcagtggtgcaatctcagctcactgcaagctccgcctcccgggttcatgccattctcctgcctcaacctcccgagttgctaacactacaggcgcccgccaccacgcccggctaatttttttgtatttttcctagagacagggtttcactatgttagccaagatagtctctatctcctgatcgtgatccaccctcctcggcctcccaaagtggtaggattacaggcgtgagccaccgtcccagccgttttttttttttttttaacagaaagaataatctgactcccactacatcaagactaatcttgttctgtgtgtttttcacatgtattatagaatgcttttgcatggactatcctcttgtttttattaaaaacaaatgattttttaaaagtcactaacaaaaacaattcactaaaaataaatgtcattatgctttaaaaaagtaacctcttgtagttataaaataaaatgtttgacttctaa

SEQ ID NO: 7 - DNA, 2457 bp, Macaca fascicularis
tctggtagtcccattaacaccggggcacacctcttccctggagctctgtgtacagagtacctcctccctaggactatacaaggactgaaccagaaggaagaggacagggcagagccatgaacatcatcctggaaatccttctgcttctgatcaccatcatctactcctacttggagtcgttggtaaagtttttcattcctcggaggagaaaatctgtggctggggagattgttttcattactggagctgggcacggaataggcaggcggactgcctatgaatttgcaaaacaacagagcatactggttctgtgggatattaataagcgtggtgtggaggaaactgcagctgagtgccgaaaactaggcgtcactgcgcatgcgtacgtggtagactgcagcaacagagaagaaatctatcgctctctaaatcaggtgaagaaagaagtgggtgatgtgacaattgtggtgaataatgctgggacagtatatccagccgatcttcgcagcaccaaggatgaagagattaccaaaacatttgaggtcaacatcctaggacatttttggatcacaaaagcacttcttccatcgatgatagagagaaatcatggccacatcgtcacggtggcttcagtgtgtggccacgaagtgattccttacctcatcccatattgttccagcaaatttgctgctgttggctttcacagaggtctgacatcagaacttcaagctttgggaaaaactggtatcaaaacctcatgtctctgcccagtttttgtgaatactgggttcaccaaaaatccaagcacaagattatggcctgtattggagacagatgaagttgtaagaagtctgatagatggaatacttaccaataagaaaatgatttttgttccatcatatatcaatatctttctgatactaaagaagtttcttcctgaacgcgcctcagcatttttaaatcgtatgcagaatattcaatttgaagcagtggttggcaacaaaatcaaaatgaaatgaataaataagctctagccagcgttgtatgcatgataatgatattaatagtttagaatcaatgctgcaaagctttatttcacattttttcagtcctgttaatatgaaaaacattggtttggcactaacagcagtgaaatgatcaagattaattacctgtcttcctgtttctcaagaatattaatgtagtttttaataggtctgtttttcctttcatgcctcttaaaaacgtctgtgcttacataagcatacttaaaaggttttctttaagatattttatttttccatttaaaggtggacaaaactacctccctaagagtaaatacaaagatacttatttacacagggaaggtttaagactgttcaagtagcattccaatctgtagccacgccacggaatatcaacaagaacacagaatgagtgcacagctaagacaacaagcttcagcaagcagctttatctcaacctggacagactttaagattcagcatttgaaagatttccctagcctcttcctttttcatcagcctgaaacggtgcaactctattctggactttattacttgaatctgtcttctgtataactcttaagtccaccaaaagtggaccctctatatttcctccctttttataatcttataagatacattacgaaaggtgaccgactgtattttaaatctgagaattttaagttctagtcccatgataacctctttctttgtagtttatgcttacatatatccttggtcccagagctgtttagacaattttaggctcaaaaattaaagctaacacaggaaaaggaactgtactggctattacgtaactaacaatggatccaagagaaggaagggaagaaagaaaaggtttttttggtttttgttgttttttgtttttgttttttgtttgtttgtttggtttgagatggagtctcgctctgtctcccaggctggagtgcagtggtgcaatctcagctcactgcaagctccgcctcccgggttcatgccattctcctgcctcaacctcccgagttgctaagactacaggcgcccgccaccacgcccggctaatttttttgtatttttcgtagagacagggtttcaccatgttagccaagatagtctctatctcctgatcgtgatccaccctcctcggcctcccaaagtggtaggattacaggcgtgagccaccgtcccagccgttttttttttttttttaacagaaagaataatctgactcccactacatcaagactaatcttgttctgtgtgtttttcacatgtattatagaatgcttttgcatggactatcctcttgtttttattaaaaacaaatgattttttaaaagtcactaacaaaaacaattcaccaaaaataaatgtcattatgctttaaaaaagtaacctcttgtagttataaaataaaatgtttgacttctaa

SEQ ID NO: 8 - DNA, 2397 bp, Homo sapiens
cagagtttagaagtcaaacgttttattttataactacaagaggttatttttttaaagcacaatgacatatttatttttagtgaattgtttttgtgacttttaaaaaaatcatttgtttttaataaaaacaagaggatagtccatgcaaaagcattctataatacatgtgaaaaacacacaaaacaagattagtcttgatgtagtgggagtcggattattttttctattaaaaaaaaaaaggctgggcacggtggctcacacccgtaatcccagcactttgggaggccgaggcaggtggatcacgaggtcaggagatcgagaccatcttggctaacatggtgaaaccccgtctctacaaaaaatacaaaaaattagccgggtgtggtggcgggcgcctgtagtcccagctactcaggaggctgaggcaggagaatggcgtgaacccgggaggtggagcttgcagtgagctgagatcataccactgcactccagcctgggcgaaagagtgagactccatctcaaaaaaacaaaaaacaaaacaaaacaaaacaaaaaccaaaaaacctttctttcttccttttcttctcttgggtccattgtttcttatgtaatagccagtacagttccttttcctgtgttagctttaatttttgagcctaaaattgtctaaacatctctgggaccaaggatatatgaaagcataaattacaaagaaaaaggttatcatggggctagaacttaaaattctgagatttaaaatagagtcggtcacctttcataatgtatcttataagactataaaaagggaggaaatatagagggtccacttttggtggacttcagagttatacagaagacagaatcaagtaataaagtccagaatagagttgcaccgttttgggctaatgaaaaaggaagaggctagggaaatctttcaaatgctgaatcttaaaatatgtccaggttgagataaagctgcctgctgaaacttgatctcttagctgtgcactcattctgtgttcttgttgatattctgtggcatggctacagattggaatgctacttgaacagtcttaaaccttccctgtgtaaataagttctctttgtatttacttttagggaggtagcttttgtccacctttaaatggaaaaataaaatatcttaaagaaaaccttttaagtatgtttatgtaagcacagaagtttttaagaggcatgaaaggaaaaacagacctatgaaaaactacgtaaatattcttgagaaacaggaagacaggtaattaatcttgttcgtttgactgctgctagtgccaaaccaatgtttttaatattatcaggactgaaaaaatgtgaaataaagctttgcagcattgattcgaaactattcatatcattatcatgcatacatctctggctggagcttatttattcatttcattttgattttgtggccaaccactgcttcaaattgaatattctgcatacgatttaaaatcgctgaggcgcgttcaggaagaaacttctgtagtctcagaaagatattgatatacgatggaacaaaaatcattttcttattggtaagtattccatctatcagacttcttacgacttcatctgtctccaatacaggccataatcttgtgcttggatttttggtgaacccagtattcacaaaaactgggcagagacatgaggttttgataccagtttttcccaaggcctgaagttctgatgtcagacctctgtgaaagccaacagcggcaaatttgctggaacaatatgggatgaggtaaggaatcccttcgtggccgcacactgaagccactgtgacgatgtggccatgatttctctccatcatcgatggaagaagtgcttttgtgatccaaaaatgtcctaggatgttgacctcaaatgtcttggtaatctcttcatccttggtgctgagaagatcggctggatatactgtcccagcattattcaccacgattgttacatcacccacttctttcttcacctgatttagagagcgatagatctcttctctgttgctgcagtctaccacatacgcatgcgcagtgacgcctagttttcggcactcagctgcagtttcctccacaccgcgcttattaatatcccacagaaccaatatgctctgtcgttttgcaaattcataagtagtctgcctgcctattccatgcccagctccagtaatgagaacaatctccccagccacagattttctcctctgaggaatgaaaaacttcaccaacgactccaagtaggagtagatgatggtgatcagaagcagaaggatttctaggatgatgttcatggctttgctctgtcctcttccttctggttcagtccttgtgtagtcctagggaggaggtactgtct

SEQ ID NO: 9 - DNA, 2289 bp, Homo sapiens
cagagtttagaagtcaaacgttttattttataactacaagaggttatttttttaaagcacaatgacatatttatttttagtgaattgtttttgtgacttttaaaaaaatcatttgtttttaataaaaacaagaggatagtccatgcaaaagcattctataatacatgtgaaaaacacacaaaacaagattagtcttgatgtagtgggagtcggattattttttctattaaaaaaaaaaaggctgggcacggtggctcacacccgtaatcccagcactttgggaggccgaggcaggtggatcacgaggtcaggagatcgagaccatcttggctaacatggtgaaaccccgtctctacaaaaaatacaaaaaattagccgggtgtggtggcgggcgcctgtagtcccagctactcaggaggctgaggcaggagaatggcgtgaacccgggaggtggagcttgcagtgagctgagatcataccactgcactccagcctgggcgaaagagtgagactccatctcaaaaaaacaaaaaacaaaacaaaacaaaacaaaaaccaaaaaacctttctttcttccttttcttctcttgggtccattgtttcttatgtaatagccagtacagttccttttcctgtgttagctttaatttttgagcctaaaattgtctaaacatctctgggaccaaggatatatgaaagcataaattacaaagaaaaaggttatcatggggctagaacttaaaattctgagatttaaaatagagtcggtcacctttcataatgtatcttataagactataaaaagggaggaaatatagagggtccacttttggtggacttcagagttatacagaagacagaatcaagtaataaagtccagaatagagttgcaccgttttgggctaatgaaaaaggaagaggctagggaaatctttcaaatgctgaatcttaaaatatgtccaggttgagataaagctgcctgctgaaacttgatctcttagctgtgcactcattctgtgttcttgttgatattctgtggcatggctacagattggaatgctacttgaacagtcttaaaccttccctgtgtaaataagttctctttgtatttacttttagggaggtagcttttgtccacctttaaatggaaaaataaaatatcttaaagaaaaccttttaagtatgtttatgtaagcacagaagtttttaagaggcatgaaaggaaaaacagacctatgaaaaactacgtaaatattcttgagaaacaggaagacaggtaattaatcttgttcgtttgactgctgctagtgccaaaccaatgtttttaatattatcaggactgaaaaaatgtgaaataaagctttgcagcattgattcgaaactattcatatcattatcatgcatacatctctggctggagcttatttattcatttcattttgattttgtggccaaccactgcttcaaattgaatattctgcatacgatttaaaatcgctgaggcgcgttcaggaagaaacttctgtagtctcagaaagatattgatatacgatggaacaaaaatcattttcttattggtaagtattccatctatcagacttcttacgacttcatctgtctccaatacaggccataatcttgtgcttggatttttggtgaacccagtattcacaaaaactgggcagagacatgaggttttgataccagtttttcccaaggcctgaagttctgatgtcagacctctgtgaaagccaacagcggcaaatttgctggaacaatatgggatgaggtaaggaatcccttcgtggccgcacactgaagccactgtgacgatgtggccatgatttctctccatcatcgatggaagaagtgcttttgtgatccaaaaatgtcctaggatgttgacctcaaatgtcttggtaatctcttcatccttggtgctgagaagatcggctggatatactgtcccagcattattcaccacgattgttacatcacccacttctttcttcaccttattaatatcccacagaaccaatatgctctgtcgttttgcaaattcataagtagtctgcctgcctattccatgcccagctccagtaatgagaacaatctccccagccacagattttctcctctgaggaatgaaaaacttcaccaacgactccaagtaggagtagatgatggtgatcagaagcagaaggatttctaggatgatgttcatggctttgctctgtcctcttccttctggttcagtccttgtgtagtcctagggaggaggtactgtct

SEQ ID NO: 10 - DNA, 1284 bp, Mus musculus
acatttgcccaagactttattatcttgcccttttgcccacatttctatttagtaatttattttataaaaacacatggattgccttttccctcctttacatatccattgccagaacccactaccaggagctgagacatctataagtataggaaactagaaggacagttgaccacgcttatgcactcgatggctgctagggtcaagcctacattttaaacatgtggaacacttaaaacatgtgaaagaaagctgtgtgtcccctctaaacttggcttcacatcattggtgtccacacgtctctgcatgcactacttcatcttggttttgtggcccacaattgcttcaaattgaatgttctgtatacgactgatcgcttttaaggcacgctcaggaagaaacttttccaggatcagagaaatattgatataggatggaacgaagatcattttcttgttggtaagtattccattgatcagactccttgcaacttcttccggctctaatacaggccataaccttgtactcgggtttttggtgaagccagtattcacgaacacagggcagagacacgaggtttggataccggttttccccaaggtgtccagttctgcggtcagtgctcggtggaagcccacagcagcaaacttgctggagcaataagggatgagataaggaatcactccatggccgcacaccgaagccactgtgacaatgtggccagagtttcttctcagcatcgatggaaggagtgcttttatgatccaaaaatgtccgaggatattgacctcaaaggtcttggtgatctcctcgtccttggcactaagaaggtctgctggatatatcgccccggcgttgtttaccacgatctcgacatcacctacttctctctttacctgatccacagagttgtaaatctcggcccggttgctgcagtccaccacaaacacgtgcacgacggcccccagtttcctgcatttgtccgcggtttcctcaacaccacgcttattgatatcccatagaaccagtctgcttttctgctttgcaaattcatatgcagtcagcctgcctattccgtgtccggcccccgtgatgagaacggtctgcccggtcacagatttccttctccggggaatgaagaactttaccagtgactccaggtaggagtagatgatgacgcccaccagaaggagaaattccaggatgaggttcatggctctgttctcacaacagacacctctgctcagagctccacagagagccctgtcaggtattatgggctgctgc

SEQ ID NO: 11 - DNA, 1730 bp, Mus musculus
ttataagtgacaacatttaatcggggctggcttacaggttcagaggttcagtccattatcatcaaggtgggagcatggcagcgttcatgcaggcatggtgcaaacacagctgagagttctgtatcttcatatgaaggctgctagcagaatactggcttccaggcagctaggatgaggttattaaagcccacacccacagtgatacatctactccaacaggaccacaccttctagtagtgccactccctggactgagcatatacaaaccatcacagatactcatataccaaggcatgggtacaatgatcagaggacaatttctctgaatcccatctgtcttcccattacatgggttctgggagttgaattcaggttgttaggcttggcagcaagtgtcttcatctactgagccaactcacaggccagagaaaacatttttagctgacaggatacaactgtctcatatattttatgttaaaaaaaataaaaatcagcccttatttcttaagtgttgtaaatattttggcagaaggagatggagtgaaattctcttgggtttatacagtcagagtgatgcagctagcatgatgacattatctacaatattttattgctgttaagaaaatcacataatttaactggcttaaaacatcagtaatagtagcacatttaaaatatgtgcttattctattttatgtgtatgagggcttgcctgaatgacgtatgcgtaccccacgagtgcctagtgtttgagaaagtctgaagagggtgtcaaatcccctgggattggagtaacaggctgttgagaaccaccatgtgggtgcttggaactgaatccaggtcctttttccaggatcagagaaatattgatataggatggaacgaagatcattttcttgttggtaagtattccattgatcagactccttgcaacttcttccggctctaatacaggccataaccttgtactcgggtttttggtgaagccagtattcacgaacacagggcagagacacgaggtttggataccggttttccccaaggtgtccagttctgcggtcagtgctcggtggaagcccacagcagcaaacttgctggagcaataagggatgagataaggaatcactccatggccgcacaccgaagccactgtgacaatgtggccagagtttcttctcagcatcgatggaaggagtgcttttatgatccaaaaatgtccgaggatattgacctcaaaggtcttggtgatctcctcgtccttggcactaagaaggtctgctggatatatcgccccggcgttgtttaccacgatctcgacatcacctacttctctctttacctgatccacagagttgtaaatctcggcccggttgctgcagtccaccacaaacacgtgcacgacggcccccagtttcctgcatttgtccgcggtttcctcaacaccacgcttattgatatcccatagaaccagtctgcttttctgctttgcaaattcatatgcagtcagcctgcctattccgtgtccggcccccgtgatgagaacggtctgcccggtcacagatttccttctccggggaatgaagaactttaccagtgactccaggtaggagtagatgatgacgcccaccagaaggagaaattccaggatgaggttcatggctctgttctcacaacagacacctctgctcagagctccacagagagccctgtcaggtattatgggctgctgc

SEQ ID NO: 12 - DNA, 1323 bp, Rattus norvegicus
ttttttttttttttttttttttttttcagcatttgtccaagattttattgtcttaccctttctcccacatttctgtttagtaaaaacacaccaaatgacttttcactcggctgtgcgacaggcattgtcttactacagctccatttccagaacccaataccaggggctgagagtttaagtataagaaaccagaaggacagttgaccactctcgtttgctcgatggctactagggccaaacctacattttaaacacaaggaacacttctaaaacgggcgaaagaaagcctcgcgtccgctctaaacttggcttcgcgtcattggcgtccacacgtctctgcacgcaagatgttacttcctcttggttctgtggcccacaatcgcttcaaactgaatattctgtatacggtttatagcttttaagacacgttcaggaaaaaacatttccactattagagagatattgatataggacggaacgaagatcattttcttgttggtaagtatcccatcgatcagactccttgcaacttcatccggctctaacacaggccataacctggtacttgggtttttggtgaagccagtattcacgaacacagggcagagacaggaggttttgataccggttttccccaaggtgtccagttctgcagtcagtgctctgtggaagcccacagcagcgaacttgctggagcaatatgggatgagataaggaatcactctgtggccacacactgaagccactgtgacaatgtggccagagtttcttctcagcatcgatggaaggagtgcttttatgatccaaaaatgtcctaggatgttgacctcgaaggtcttggtgatctcctcatccttggtgctaagaaggtcggctggataaattgccccagcgttgtttaccacaatctctatgtcaccaacttctttctttacctgatccacagacttgtaaatctctgcccggttgctgcagtccaccacaaacacgtgcacgacagcccccagtttcctgcatttggctgcggtttcctcaacaccgtgcttactaatatcccacaggaccaatctgcttttctgctttgcaaattcataagccgtcagcctgcctattccgtgtccagctcctgtgatgagaacagtctgtccggccacagactttcttctctggggaatgaagaactttaccagtgactccaggtaggagtagatgatgatgcccaccagcaagagaagctccaggatgaggttcatggctctgagctgctctctcccttggactctgttctcctagcagatgcccccgcacggagctccacagaga

SEQ ID NO: 13 - DNA, 2529 bp, Macaca mulatta
ttagaagtcaaacattttattttataactacaagaggttacttttttaaagcataatgacatttatttttagtgaattgtttttgttagtgacttttaaaaaatcatttgtttttaataaaaacaagaggatagtccatgcaaaagcattctataatacatgtgaaaaacacacagaacaagattagtcttgatgtagtgggagtcagattattctttctgttaaaaaaaaaaaaaaaacggctgggacggtggctcacgcctgtaatcctaccactttgggaggccgaggagggtggatcacgatcaggagatagagactatcttggctaacatagtgaaaccctgtctctaggaaaaatacaaaaaaattagccgggcgtggtggcgggcgcctgtagtgttagcaactcgggaggttgaggcaggagaatggcatgaacccgggaggcggagcttgcagtgagctgagattgcaccactgcactccagcctgggagacagagcgagactccatctcaaaccaaccaaacaaacaaaaaacaaaaaacaaaaaacaacaaaaaccaaaaaaaccttttctttcttcccttccttctcttggatccattgttagttacgtaatagccagtacagttccttttcctgtgttagctttaatttttgagcctaaaattgtctaaacagctctgggaccaaggatatatgtaagcataaactacaaagaaagaggttatcatgggactagaacttaaaattctcagatttaaaatacagtcggtcacctttcgtaatgtatcttataagattataaaaagggaggaaatatagagggtccacttttggtggacttaagagttatacagaagacagattcaagtaataaagtccagaatagagttgcaccgtttcaggctgatgaaaaaggaagaggctagggaaatctttcaaatgctgaatcttaaagtctgtccaggttgagataaagctgcttgctgaagcttgttgtcttagctgtgcactcattctgtgttcttgttgatattccgtggcgtggctacagattggaatgctacttgaacagtcttaaaccttccctgtgtaaataagtatctttgtatttactcttagggaggtagttttgtccacctttaaatggaaaaataaaatatcttaaagaaaaccttttaagtatgcttatgtaagcacagacgtttttaagaggcatgaaaggaaaaacagacctattaaaaactacattaatattcttgagaaacaggaagacaggtaattaatcttgatcatttcactgctgttagtgccaaaccaatgtttttcatattaacaggactgaaaaaatgtgaaataaagctttgcagcattgattctaaactattaatatcattatcatgcatacaacgctggctagagcttatttattcatttcattttgattttgttgccaaccactgcttcaaattgaatattctgcatacgatttaaaaatgctgaggcgcgttcaggaagaaacttctttagtatcagaaagatattgatatatgatggaacaaaaatcattttcttattggtaagtattccatctatcagacttcttacaacttcatctgtctccaatacaggccataatcttgtgcttggatttttggtgaacccagtattcacaaaaactgggcagagacatgaggttttgataccagtttttcccaaagcttgaagttctgatgtcagacctctgtgaaagccaacagcagcaaatttgctggaacaataagggatgaggtaaggaatcacttcgtggccacacactgaagccaccgtgacgatgtggccatgatttctctctatcatcgatggaagaagtgcttttgtgatccaaaaatgtcctaggatgttgacctcaaatgttttggtaatctcttcatccttggtgctgcgaagatcggctggatatactgtcccagcattattcaccacaattgtcacatcacccacttctttcttcacctgatttagagagcgatagatttcttctctgttgctgcagtctaccacgtacgcatgcgcagtgacgcctagttttcggcactcagctgcagtttcctccacaccacgcttattaatatcccacagaaccagtatgctctgttgttttgcaaattcataggcagtccgcctgcctattccgtgcccagctccagtaatgaaaacaatctccccagccacagattttctcctccgaggaatgaaaaactttaccaacgactccaagtaggagtagatgatggtgatcagaagcagaaggatttccaggatgatgttcatggctctgccctgtcctcttccttctggttcagtccttgtatagtcctagggaggaggtactctgtacacagagctccagggaagaggtgtgccccggtgttaatgggactaccagatagaagccagctttggaagcaggccttgttcacgtgtcctaaggtgttggaaacacctcaggtttttgaag

SEQ ID NO: 14 - DNA, 2457 bp, Macaca fascicularis
ttagaagtcaaacattttattttataactacaagaggttacttttttaaagcataatgacatttatttttggtgaattgtttttgttagtgacttttaaaaaatcatttgtttttaataaaaacaagaggatagtccatgcaaaagcattctataatacatgtgaaaaacacacagaacaagattagtcttgatgtagtgggagtcagattattctttctgttaaaaaaaaaaaaaaaacggctgggacggtggctcacgcctgtaatcctaccactttgggaggccgaggagggtggatcacgatcaggagatagagactatcttggctaacatggtgaaaccctgtctctacgaaaaatacaaaaaaattagccgggcgtggtggcgggcgcctgtagtcttagcaactcgggaggttgaggcaggagaatggcatgaacccgggaggcggagcttgcagtgagctgagattgcaccactgcactccagcctgggagacagagcgagactccatctcaaaccaaacaaacaaacaaaaaacaaaaacaaaaaacaacaaaaaccaaaaaaaccttttctttcttcccttccttctcttggatccattgttagttacgtaatagccagtacagttccttttcctgtgttagctttaatttttgagcctaaaattgtctaaacagctctgggaccaaggatatatgtaagcataaactacaaagaaagaggttatcatgggactagaacttaaaattctcagatttaaaatacagtcggtcacctttcgtaatgtatcttataagattataaaaagggaggaaatatagagggtccacttttggtggacttaagagttatacagaagacagattcaagtaataaagtccagaatagagttgcaccgtttcaggctgatgaaaaaggaagaggctagggaaatctttcaaatgctgaatcttaaagtctgtccaggttgagataaagctgcttgctgaagcttgttgtcttagctgtgcactcattctgtgttcttgttgatattccgtggcgtggctacagattggaatgctacttgaacagtcttaaaccttccctgtgtaaataagtatctttgtatttactcttagggaggtagttttgtccacctttaaatggaaaaataaaatatcttaaagaaaaccttttaagtatgcttatgtaagcacagacgtttttaagaggcatgaaaggaaaaacagacctattaaaaactacattaatattcttgagaaacaggaagacaggtaattaatcttgatcatttcactgctgttagtgccaaaccaatgtttttcatattaacaggactgaaaaaatgtgaaataaagctttgcagcattgattctaaactattaatatcattatcatgcatacaacgctggctagagcttatttattcatttcattttgattttgttgccaaccactgcttcaaattgaatattctgcatacgatttaaaaatgctgaggcgcgttcaggaagaaacttctttagtatcagaaagatattgatatatgatggaacaaaaatcattttcttattggtaagtattccatctatcagacttcttacaacttcatctgtctccaatacaggccataatcttgtgcttggatttttggtgaacccagtattcacaaaaactgggcagagacatgaggttttgataccagtttttcccaaagcttgaagttctgatgtcagacctctgtgaaagccaacagcagcaaatttgctggaacaatatgggatgaggtaaggaatcacttcgtggccacacactgaagccaccgtgacgatgtggccatgatttctctctatcatcgatggaagaagtgcttttgtgatccaaaaatgtcctaggatgttgacctcaaatgttttggtaatctcttcatccttggtgctgcgaagatcggctggatatactgtcccagcattattcaccacaattgtcacatcacccacttctttcttcacctgatttagagagcgatagatttcttctctgttgctgcagtctaccacgtacgcatgcgcagtgacgcctagttttcggcactcagctgcagtttcctccacaccacgcttattaatatcccacagaaccagtatgctctgttgttttgcaaattcataggcagtccgcctgcctattccgtgcccagctccagtaatgaaaacaatctccccagccacagattttctcctccgaggaatgaaaaactttaccaacgactccaagtaggagtagatgatggtgatcagaagcagaaggatttccaggatgatgttcatggctctgccctgtcctcttccttctggttcagtccttgtatagtcctagggaggaggtactctgtacacagagctccagggaagaggtgtgccccggtgttaatgggactaccaga

SEQ ID NO: 15 - DNA, 19118 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtaatgtatacatcttccaactttttaaagtcacagagtaagatatgtattttaagaattatttgacttaccatctacttatctttgtatttttgtttttcaaagtttgataaattccctggtcccttagtctgtatatgtgtcaggttagttagatgaagggaatgtaattaagaactaagcagcgatttttatgacatggtgtgcaggttgatagaaagactcaggagccagtctccttccaagctgctaaatgaggcaagtcacatattatctctcagcctgttttcttggctctgaagtggggataataacttaggggatgggcaagaacgggatctgaaaattacagctacaaacaaaagtcaaacgaagaacttgcaacagaaacctttagtgcctcccctcatgcacaagcaacacagttctaaaatatttactgtctgaccctttacagaaaatgtttgccagtccgtagtcaaaaggattaaataagtaatattttcagcacttagcatatgataaacgatacgtggcacatgataaacaataactgtgttaaataaaatatgtgcgcagtgagtcaggcttttccttggacattagtatttttcctgtgttcttacttgtaaacactacattaacaaccccaaataaaactgaaggaactgaaatcttgtatcattttctctaaacttgtaaattctggtaaggccatgaaaatatatgcagagaagtgtttacaggattttaggattggaaaaattgtgaagtactccttgagaatcacattttctgcaaattacagtggttttaattaccattatattattactttctcatgttctttgctgtcatgtttagttgaaacctaaaatgtctcttacacttagagaactaattcttttctgttttttttctgaatagtgaagaatactatacaaaaaagctactacatttttatttaacagatatgagcatttatataatagaggagttgatgtatataaaaatgatttgccatctttttggtctttgaagaaattcgaatgaactttctggaagatagcaagaatttacaaatagagaaaattgttgcctgctgttctcaggcatttgtccaaaaatataaataagtataaatctatgaaaagggcttgatgaaatctaaccttcaaatctctttccagatgtgtatttttggggaaagggctatatttattaagttttttttaaattttaaaatttccagagacaagagaaaagtaaattagaaggaagtcgtattaaaaatgacttaagggcgggtgcagtggctcacacctgtaatcccagcactttgggagacggaggtgggcagattgctggagcccaggagttcaagaccagcctgggcagcacagcaaaacccccaactctacaaaaaatacaaaaattagctgggtgcgggggtgcacacccgtagtcccagctactcgggaggctgaggtgggaggatcgtttcagttcaggaagccaaggctgcaatgagctatgatggcatcattgcactccaagctgggcaatagagccaggctctgtctcaaaaaaaataaaaaaagacttaagaaaaataggtaacccaacctcaaaaattctctttgaatcattaaatttcatggttaaacatttaagctactgaatgattcactctaaggctgtaatgtaactcagatctcctttaggcgaggaagatgctggctgagttttcatcataactggctccttttgccctgtgagatgagagacacagtagcagtttggctcttatgcaatctaaactgttgcgttgggaatacggttcaaaaaacacattggagtttaagctaaagcaagtgttttgctaacaaaaagacaaggcatcacattttgcaattgtctagctcagttataaaacagaagaataggccggacgcggtggctcacgcctgtaatcccagcactttgggaggccgagacgggcggatcacgaggtcaggagatcgagaccatcctggataacacagtgaaaccccgtctctactaaaaatacaaaaaaattagccaggcgtagtggcgggcgcctgtagtcccagctactcgggaggctgaggcaggagaatggtgtgaacccgggaggcggagcttgcagtgagccgagatgacgccactgcactccagcctgggcgacagagcgagactccgtctcaaaaaaaaaaaaaaaaaaaaaactgaagaataattaattcttcaatcaaaacatctgatgaatgctctggtaacttatgctctctactgacctagaaacaaatgagagagtatggtgtggtttgtgcaatctggcagtgagcaagctaccaactaaatcagtgaaagactctcctattctttttttactcttctgcaatcccacaaaaggctatttgaggggatactgactttgagactgggtcctaacatccatgtttggggagttcaggctgctgctccagggtttagcctacagtagcgaaatacaaaggacccagagaccactcattcaaggtttgccctaaatagcagcaacaccactgtcatctcaatacacgaagaatagggcttttcaggtatccttgcctctttgtcacagagaagagtttacagattgtgagacggaaaagtataatttttaaaaccttataatattttctataaaagtcacctgaggtgaaaacttgaaaagaattataattttccagaatgtgagtcaagaaacattagagcaattttatcttaggaaagaggtctttgaatttaggctgaaagtaaattgctctgtctccatgtcctatggttatgggcaagtttggtacataaatgagaaatccatccagtggccttgcccatctcactcccaaacacctgaagaatgtaatgttatatctcctagagtagcagcatggtctccctatgaaagtccttcttctttaaggagacttctttcccttccctcctaggaggatgagtcagaatcatcaagaaaaatatgatgggcagaggcatacagtttaccattaccactagtttagaattactacttagcactttactgcctattacatagttggtgctcaacaaatgtatgataaattaatggttgagtttttctttcttctccatattcatcttccatgacaccacgaagagcaatgtttttcaagaatgttcttcaaggtttgaaagtagcctgctttagagaaactgcctactgtacagcctccaaccaagaggaaaagctgaaaaaagcatgaagggattttgttttgttttgtttgttttggttttaatatgagcattccctggcagaaaagccaggggtaatctcattgcaactaggcaatcactctcaagaaattttctaacaaataaggaggccaatttttattttattttgagacgaagtcccactctgtcacccaggttggagtgcaatggaatgatttcagctcactgcaacctccgcctcccgggttcaagtgattctcctgtctaaacttcccgagtagctgggattacaggctcccaccaccacgcccagctaattttttgtatttttagtagagatggggtttcaccattttggccagactggtctcaaactcctgacctcaagtgatccaccctcctcggcctcctaaagtgctgggattacaggcgtgagccaccacacctgacccaggaggccaatttttaaaaggttaactaatcttcatgtccaaaatgaatgttaattgttcattttggacatgaatgttaattttttttttttttttttttgagacagagtctcactctgttgcccaggctggagtccagtggcactatctccactcactgcaacttcctcctcccaggttcaagcaattatcctgcctcagcctcccaagtagctgggattacaggcccacaccatcaggcctggctaatttttgtatttttagtagagacggggtttcaccatgttggccaggctggtcttgaactcctgacctcgtgatccgccctcctcggccaaccaaagtgctgggattacaggcgtgagccaccgcgcctagccgaatgttaattgtctaaaaatttttcttctccaatgtcttctcctccacttttttcggaatttgtttcttcctaattacagcgcggtgtggaggaaactgcagctgagtgccgaaaactaggcgtcactgcgcatgcgtatgtggtagactgcagcaacagagaagagatctatcgctctctaaatcaggtgagactgcaggttcacaaatttcttcagattattttgtttcctaggacgctgacgtggaaaatgagaaaggtctttatgactgcctgatttaaattggattttagctgctaactgaagtagttatgtcaccaaggaaggatatatactttttttcttgtatgtaatccactcagctctgcccattattattgttcatattattaatcaatttcattctgatcagaagtgtgagcagtggcacagagtgactgacaaaagatttatcatcagggaatatggatcacttcctagttttgttttagtcctattaactttgcagtaattccagcttctctttaattatttcccttgtgagattttattttggtgttaatgtagtcttctgtagaaaatgtaatattaataattattatcacaattattttaaaagagtaaataccaaataatcacaatgaactaagcactctaacaaactttacattttttaattcaatccctacaataactctgtaaacttcattttacagataagcaaattatgactcagagaggttaagccagacccaggtcatgtagttattaggttatgaaaccaggatttctcaaccagcactttagaccaggtgcggtggttcacacatgtaatcccagcactttgtgaggccaaggtggaaggatcacatgagaccaagagttcaagaccagcccaggcaacatagtgagaccctatctctaaaaaaaaaaaaaaaaaaaaaaaaaaaagtttaaagaaaaacacatttttaaaaaatgaacactttaaaaatatttggtcagaatttatataggaatttatcaacataaatgttaatttcactttactgataaacttgcaaaacatgatgtgctgggtactgaaatttagatgttaaaagaacagtttatcccacctttatgacagtgttcccttggcctccacgatttgagctcaacagtctgtcttgcctgaactctgagagacctcatacaatagaagaaagactctcatctttggattatattggtcccaaaactttgagtttgaataatacacccagtgaaagtgttctttcaatttcaaaaggtgaagaaagaagtgggtgatgtaacaatcgtggtgaataatgctgggacagtatatccagccgatcttctcagcaccaaggatgaagagattaccaagacatttgaggtcaacatcctaggacatttttgggtgagtgtgagtcagaaacatttctgatttgtgcaccttctcttaagatacatgaaacttataacggagttcacatacttctggacaggaaactggccagatctttgccttaatcaagaatcattaaatttgtttgagtagaagagccacagagtctctgacacaaggacacagaattcaagtggacacaacacaccagaatgtaagctacttggtctgtcttgtccaccagtatctgacacaaagcttggcatgtaccaggagctcaacaaatgtttgtggaggtttgttaagggttgtcagtgtacatcttttcaatgctgtcacttgtgacttcatttttttccctccacaccatgattttgtaatgtgtcctcattttgtggaattttagaatggaaaggacatcagaagtaattacttggatgtatataggatcgaggacacttttggacgagactctgaggcaagtgttctagatccatggggtgctggaactgagaaatgcagctatacagacctcatataattggttagttttgtgggagatggaaatatcaacttcaactgcctttgtatagaaatttttatgattaatcttccagtgcctcaatattagtgtagaatctagggcagatctggattctagaagaaagaagaaaaaaaagagatgtgtcccccttacctttaccagctcttcacatatgtgaattggctcccatgcccaccaaactacacggagacctcatacattagctacctatagctgcataacaaattatacaaaacttagtggtttaaagcaacaatgtatgttcactatcctctcacagtttctatgggttgggaatttggaggtagcttgggttgggagttctagttctatgaatttgcataggatttattaaattcttataaaattttattgatgtttctcacaaaagaggtttttggaaaaaaagaaagacttgttttctgtaacatcaacatataatatacaatattacaaatagggagatagtgaattcaatcatgattcattagtgtggtgtagaactctcagcttacactactcaactgtcttaatacagttacacaagatttcactcttttaattagaatgataaagccccaaaccaaaaaattatatgacaccaaattatcataaggaataattttagttctgaaaactctgaatttttcccttaatattgtttagatgacatatccaaaaaaggatctatttgattccttctgaagggaaggagggggagtactgagattagtgttggcatggggcttaccataccaataaatttgtatctttatttctatcatttgtaaagaattaatcatggaatgcttggaagtattttatttcattgtataagttctctcaaatgcctttctgtcttaacaaaaataaaactacctgatttggaaacctaacgtctatgtcattgtctttcttctttctgcaatgatccttaagatcacaaaagcacttcttccatcgatgatggagagaaatcatggccacatcgtcacagtggcttcagtgtgcggccacgaagggattccttacctcatcccatattggtaagtatcacatgccagccatgttatatatttttatactttgaagggagcattacacttcaaattgttaccactggagagtcctggttcttggcatcttgaacaaagaattggacaaaactcaccaacaaagccaggaaagaatgaagcaacaaaagcagagatttattgaaaatgaaagtacgctttacagggtgggagtgggcccaagcacaggggctcaagagccaattacagaattttctggggtttaaataccccctagaggtttccactggttacttggtgtacgccctatgtaaatgaagaggatgaattaaagttacagagtcgtttactcagtgtacaccatatgtaaatggagaggatatttcctgtcatagctggagtgtttccatttgatttagttctaggaagtcagcatgaatcggccttatgttccctgcctccagaccctgttctcctgcctcaagattacaatgctgagagcagagtgatttggatttacagaatttaaatttatagtagtttagaatgattttttaaatgactttttctaaaacaatgaaaccaggttgtaattatatttaagatatttttagatttctgcaaactcctctgtagaacaatgagagaaaacagtaatgccaagcatgtttccattgtttcctggaataagaaacagaaaccccacagactgagaagcaaaacctacagaagctaaaatgaacacatgtctatgtcatggccttggtgcccaagataagacaatcagagtggtccctggatcaaaacattttacagtgtgcttgtgccatgaaagtgtgtgtgtgtgtgtgtgtgtgtgtgtgagagagagagagagagagaaaacgactctacctgactaaaagttgcagataccacactccatgcaccaccaaagacataaagggaaggaggtgagaggcgttaaggatgtactgctgtatttgccaaatatcctttcctgtaaactcttctccagatcctcataataaaattaagaggccaaagtggcaaccattgtcaagagaaaaactatcaaccattgtcaagagaataactcagttattgagagagagaggagaaatgagcagagtcctacagaagtctgtcaacacagataccagttttgtagaatttctaaatgtatttttcctgattcatatttttcaaaataaaagcagcaataaaaactgattagaaaacagtttgaagattcaatggaaaaaccttacatgtaggatggaaaactgaacattaagccaatcaatagagttatttttgttcttttgttatcattgttgtttaagaaatgagatacgttcacaattctgcttaatcatgtaagaaaatgaaaatgaattgccatttatactctcagaaaaatcacaagtggctgatttttggcttccacttgttcttaagccaaatgataccgccttctcacagaaagctgaggattggtttcactctcccttagctaacaatgcttaataattctcttacagttccagcaaatttgccgctgttggctttcacagaggtctgacatcagaacttcaggccttgggaaaaactggtatcaaaacctcatgtctctgcccagtttttgtgaatactgggttcaccaaaaatccaagcacaaggtaaggtcaaaatcaagttagaatgggtatgtggtatgataaattgatatgaaaactaatgagaaatgtttaggcaggccaactaatagaagaaaatgaagaaggaaaaataatttttcttattattattattatcttgaaattaaaggaataaagggggaaaacacattagggactagcaggaatgatcagccaccgatgaactgggatatttatttgtgtccgggagaaagcacatacatttgatcaccgttaccaccctgtctttaaaatgcaaatgttccaaggaccagcaaataaattgagtatctagctccttagtcaaggtgaatttctgcaagaactcttgtctctggtgagacaggatttgagaccacaagagaagaaaaattagtcctgaaaggagaagaaaaaagcaggaaggtgtggataagaacccgaaaattaagccatctgcttaacaaatttttctaatcctagtatatattctgctgcaggttaacaaaatatactaagcttaatgattcgaaaccaattttttactggaagggaattaatcctaaatatattcattcaaaagaactaaacaattctctgttgagtgccgcctcatttgaggatactgactcttacagcctgagttagctatgtggtctctgcagctggaatcactccctgccactggagtccttcatggtgttagaccataggtactgttgactaaagaaaaaaaaaagtttttgtttttatttttgttttttttgagacagagtctcactctgtcacccaggctggagtacagtggcgcgatctcagctcaccgcaacctccgcctttctgggttcaagcaattctccttcctcagcctcctgagtatttggattacaggcgcccaccaccacgcctggctaatttttgtatttttagtagagacggggtttcaccatgttggccaggctggtctcaaactcctgacctcaggtgtcctacctgccttggcctcctaaaatgctgggattacaggagtgagccaccatgcccggccaaaaaaataagtttttaaagaattaaaggtcatcctggctaacacagtgaaaccccgtctctactaaaaaacacaaaaaaattagccgggcgtggtggcgggcgcctgtagtcccagctgcgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaattaaaggtgttaattttatttagaagccttactgaagactacagtcggaggcctatagcctgagagcagccctttagagaggttcagttgaactgttctgatagtgggggccatgtgctctatcctgtattgtcttcaaagcatctttccagagagctgcacattgtcacagagtcagggactttgtgaaattatgctgacaaccagaagtgagtaaacgtggcttcttacatttgctacgttgtctcacagtacttaataagtatgcaatatgtaagtaaatactatagtactattgcaactcctgattgttttcttagacaaggaattgggcccaataaaaaccctcttggtaggcattcaggcttcgtgtaccatgagctttcctaagggtatcctgccactcttggggaaggcatgatagatgaggggagtaaggataatggaactctgggtacagggttcctgggggctaacttagaggtagacacaggcaatgctaaatatttgggattgattttatagaggttgctagattgtgaatttccttagtaagggctaaggcattgatatgtaatgtcacacttggctccgaggctgggttgttggatccatgtagatgaaatcagggagagaaagggcagaacggagtaatttagaaatgtattgatttgtattactctctgttggcttgctattcaaggcagtggagaactcaatcacataataatctgcagcaaaccacagatcatcccagggaatgaagttttaacattcgctggctccctaactcctcacccagcctttacattcactggctgttcagtccatgcctggacatcttaatttgaatacaacattttaaatccatttttctgtcatcatcttgcactaacagacaattctacactaagcctatgtttatgaatatttctcaagagtacatgtacacagccttcagtataaggaaaactggaagtatgacatacctccagttgtcatactccttgggcccctcttaaattctcattaaactgcaggataggcaagtcagaggtgaatctcaaatacgaaattcttaccggaaaggggttccaatccagaccccaagagagggttcttagatttctcgcaagaaataattcggggcaaggccacagtgcaaagcaaaagcaagtttattaggaaagtaaaggagtagagaacagctactccatggagaagaatggcttgagctgctccaccaagggtatttagagttacttcttgattatatgctaaacaaggggtggattattcatgagttttccgggaaaagggtgagcaattcccagaactgagatttcctcccctttttaggccatatagggtaacttcctgccattgccatggtatttgtaaactgtcatagtgctggtggaagtgtctcttagcttgctaatgtattatagttagcttataatgagcagtgaggacaaccagaggtcactttcatcaccatcttggttttggtgggttttggccggcttctttactgcaccctattttatcaacaaggtctttatgacctgaatcttgtgccaacctcctatctcatcctgtgacaaagaatgccttaacttcctgggaatgcagcccagtaggtgtcagccttattttacccagaccctattcaagatggagttgctctgatttaaacgcctctgacaaaatgacgacctcaaaacaatccagctttatggaatacctccacaagaaagaaagtatacttagctatagaattttctccttgcatccaacaggctttgagatgtcagatgtttccttcctgtcccatgattaatcctagccattcctctttcttgtctggctccactactccttaccatctaatgcctcgccaccattttgatattttgactaagtgagctatgaaacacacctactggatatgaaagtataagtttctgataacaaaacatcaacatgggatgtggaggaagtgggtagggtggcattaatgcagcaaatcctggaatattttaaatcttcattctaaatttagtaaaaatataggataattttcctgccatcatttacttataaaattaaaattttagaaaataaaaataatattttcctctttttaatcacagattatggcctgtattggagacagatgaagtcgtaagaagtctgatagatggaatacttaccaataagaaaatgatttttgttccatcgtatatcaatatctttctgagactacagaagtaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttttttttttttttttttttttttgagacagagtttcacccttgttgcccaggctggagtgcagtggcgtgatcttggctcactgcagcttctgcctcctggcttcaagtgattctcctgcctcagcctcccaagtagctgggattacaggcacctgccccctcgcccaactaactttttgtgtttgtagtagagacagggtttcaccatgttggccaggctggtctcgaactcctgacctcatgtgatccacctgcctcagcctcccaaagtgctgggattacaggcatgagccatcatgcccagccctatttgacggtttttgacgctaatgcaagtggcattttaaaaaattttatatttcccattgtttgttgtcagtatatattggatttttgtaatttgatctcatattttgcagtcttgctaaattgctaaacctctttttgctaaactcgataagcttttttttttttggtagattcctgggcctctaattttctttatgggaaagtttttaattacaaatttaatttctttaatagctacatggctattcaatttacttattaattcttggtaatgtgtgtctttcaaggaatttgtccatttcatctaagttgtagaatttctttggcataaatttgtacataacattcccttattatccttttaatgtctttagaatgtcttatttatttatttatttatttttattatatttttttgagacagagtctcgctctgttgcccaggctggagtgcagtggcacaatcttggctcactgcaagctccgccttctgggttcatgccattctcctgcctcagcctccctagttgctgggactacaggcgcctgcaaccatgcccagcttattttttttttttttttttttttttttttttttttttttttttttttagtagagacggggtttcaccctgttagccaggatggtctcgatctcctgacctggtgatccgcccgcctcagcctcccaaagtgctgggattacaggcgtgagccaccaagcccagcctatttatttatttagtagagacagtctcactttgctgcccaggcaacaaaggttttgaatgcctggcctcaagcagtcctcctgccttggcctcccaaagtgctgggattacaggcatgagccactgcacctggccaaatgaatatgctgataatatcttctttataaggatgacataagaataaaataatgtaatacaaacaaagcccctgtcactgaaaatgtatagacttcaaatgttaaagtcttagagaacagaatttatatgaaatagcaacagcaacaatttcccagaggaaatactctctcagctttcttctgaggagcagtttctaaattgaaattgtatcagtgagaagataactatactaacttcataagccttgggcctttttgaaacaaatccatataaactatgaacaaacttgaaatagaacaatttgagaacagggtacaaactgcattggtgtatcaatttcagtatttggttttagcttaaatagactgacttgagataacataaggagaaccttgacccccaagcaacatcatctcgcgagttgactaggccgggtgtggtgtctcacgcctgtaattccagcactttgggaggccacagcaggcagatcacttgaggtcaggcattcgagaccagcctggccaacatggtgaaacctcagctctactaaagatacgaaaattagcaggcatagtggcctgcacctgtaataccaggcactcgcaggagaatcccttgaacccggaaggcggagattgcagtaaaccatgattgtgccactgcactccagcctgggcaacaggagactctgtctcggaaaaataaattttttaaaaaaatgaaaaaaaataaaagttgactaaattagtgtcttggtactaagcactgtaggaagtgagtttcatggaaccccaactctcttggggcccaaagcaagtcatattaatattgaaaattacatgcatatacatgcatatgaccaaggtgataaaaacaattattctgcctgagttggagaatagtatcccagtaaaataaacaagagtctcaaagtcttttgtatcctttgaagctgtcatggtggtttgtaactaggcaacaggtatatattgttaatcttctttgcatttaattccttttatagagagacacaattttacgagcagatgcaattactagcatgaaggtttctttgtgagggtagttaaaaggcccacatgagctctcttcttatccttgtccttctttcagccagatcttccctgcccctttgctcattccatctttcacccacctacccccaaaacaaggaagtaaatcttgcattagtcaacaataccaaagtgattttcaatatgactttctctgcagaatgttattatttctgcctctttacattcacatactgtcttcctttttttttttttttttttttttttttttagattgggtctcactctgttgcccaggctggagtgcagtggcttgatctcagctcactgtaacctccacctcctgagttcaagcaattctcctgcctcagcctcctgagtagctgggattacaggcatgtgccaccacacctggctagtttttttgtatttttagtagagacagggtttcaccatgttggtcaagctggtctcgaactcctgacctcatgatctgaccacctgtgcctctcaaagtgctgggattacaggcgtgagccaccgggccagccactctcttcctttcagttgcctactcatctcttatgcattcctggacatcagttgtccttttgaagctttcctccactatcccagcccatgtgaatcctccttccagttatagcccttaattctagatggctgatatttttcaataattgttttaagatgaccattttagcctatcagctaaacaatatcaaagacaatagctatttttcaagtactttagtttaccttattatagagtgcataatagatattcagtaaatagtaaaggagaggtgaaggcttgcatagaatggattctggtggtgtctcttggtgagcttttagcatcaagattaatcagcagtttcagcaatgagctcagaccttcagttttagatctttactcatatcagataagagagtgagaagagtggtatgtatcagtgctttatttatatttgcatccaatttgaactatgaatattacaaaggtgcacacataggttcagacagattgatttaaaatgaccaaagatgacctgtcgtaagcaacctgggtatcttaagatgcactccttggagagggaatgttcctaaaaacattttcagagggacgaactgtatgaaattcagtaaaacataaatcatgaggaaaactgattactctctttttgacatgaaatgagagttttaatgcatggttacgattattaacgtactccgctgcaagacgttaataaagttactgttttgcaggctagaatgtcttgatgctgtaatcagaacacactttttcccctttcttccagcttcaaatgcagattcataattgggctgacttctaataactgcaatgttttctgccttgggcttgcagcagaagcctgacaaaatagtgtttgtttaggcaataatttatttatttatttattgagatggagtttcattcttgtcgcccaggctggagtgcaatggcgtgatctcggctcactgcaacctctgtgttcaggcaataatttagactttaccttacttgtgattactatagcaattactatagccacaaggcataattttactgtctcatttcaattttatgaatttgaatgtttttacacttttcctaatgaagtccactatgaagttatgtcaaaaaaaaaaaagaaaaagaaagatgcacacgtaaaagagaggtggttgcaagagaagaaaagaacggaggaaagttaaacgcaaaccagataactctcagcgtattctaaatgaccaaaaacagaactctgttgtcaaagattttaaatggaaaatttttcaatttttttttcttttttgtacaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 16 - DNA, 19119 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtaatgtatacatcttccaactttttaaagtcacagagtaagatatgtattttaagaattatttgacttaccatctacttatctttgtatttttgtttttcaaagtttgataaattccctggtcccttagtctgtatatgtgtcaggttagttagatgaagggaatgtaattaagaactaagcagcgatttttatgacatggtgtgcaggttgatagaaagactcaggagccagtctccttccaagctgctaaatgaggcaagtcacatattatctctcagcctgttttcttggctctgaagtggggataataacttaggggatgggcaagaacgggatctgaaaattacagctacaaacaaaagtcaaacgaagaacttgcaacagaaacctttagtgcctcccctcatgcacaagcaacacagttctaaaatatttactgtctgaccctttacagaaaatgtttgccagtccgtagtcaaaaggattaaataagtaatattttcagcacttagcatatgataaacgatacgtggcacatgataaacaataactgtgttaaataaaatatgtgcgcagtgagtcaggcttttccttggacattagtatttttcctgtgttcttacttgtaaacactacattaacaaccccaaataaaactgaaggaactgaaatcttgtatcattttctctaaacttgtaaattctggtaaggccatgaaaatatatgcagagaagtgtttacaggattttaggattggaaaaattgtgaagtactccttgagaatcacattttctgcaaattacagtggttttaattaccattatattattactttctcatgttctttgctgtcatgtttagttgaaacctaaaatgtctcttacacttagagaactaattcttttctgttttttttctgaatagtgaagaatactatacaaaaaagctactacatttttatttaacagatatgagcatttatataatagaggagttgatgtatataaaaatgatttgccatctttttggtctttgaagaaattcgaatgaactttctggaagatagcaagaatttacaaatagagaaaattgttgcctgctgttctcaggcatttgtccaaaaatataaataagtataaatctatgaaaagggcttgatgaaatctaaccttcaaatctctttccagatgtgtatttttggggaaagggctatatttattaagttttttttaaattttaaaatttccagagacaagagaaaagtaaattagaaggaagtcgtattaaaaatgacttaagggcgggtgcagtggctcacacctgtaatcccagcactttgggagacggaggtgggcagattgctggagcccaggagttcaagaccagcctgggcagcacagcaaaacccccaactctacaaaaaatacaaaaattagctgggtgcgggggtgcacacccgtagtcccagctactcgggaggctgaggtgggaggatcgtttcagttcaggaagccaaggctgcaatgagctatgatggcatcattgcactccaagctgggcaatagagccaggctctgtctcaaaaaaaataaaaaaagacttaagaaaaataggtaacccaacctcaaaaattctctttgaatcattaaatttcatggttaaacatttaagctactgaatgattcactctaaggctgtaatgtaactcagatctcctttaggcgaggaagatgctggctgagttttcatcataactggctccttttgccctgtgagatgagagacacagtagcagtttggctcttatgcaatctaaactgttgcgttgggaatacggttcaaaaaacacattggagtttaagctaaagcaagtgttttgctaacaaaaagacaaggcatcacattttgcaattgtctagctcagttataaaacagaagaataggccggacgcggtggctcacgcctgtaatcccagcactttgggaggccgagacgggcggatcacgaggtcaggagatcgagaccatcctggataacacagtgaaaccccgtctctactaaaaatacaaaaaaattagccaggcgtagtggcgggcgcctgtagtcccagctactcgggaggctgaggcaggagaatggtgtgaacccgggaggcggagcttgcagtgagccgagatgacgccactgcactccagcctgggcgacagagcgagactccgtctcaaaaaaaaaaaaaaaaaaaaaactgaagaataattaattcttcaatcaaaacatctgatgaatgctctggtaacttatgctctctactgacctagaaacaaatgagagagtatggtgtggtttgtgcaatctggcagtgagcaagctaccaactaaatcagtgaaagactctcctattctttttttactcttctgcaatcccacaaaaggctatttgaggggatactgactttgagactgggtcctaacatccatgtttggggagttcaggctgctgctccagggtttagcctacagtagcgaaatacaaaggacccagagaccactcattcaaggtttgccctaaatagcagcaacaccactgtcatctcaatacacgaagaatagggcttttcaggtatccttgcctctttgtcacagagaagagtttacagattgtgagacggaaaagtataatttttaaaaccttataatattttctataaaagtcacctgaggtgaaaacttgaaaagaattataattttccagaatgtgagtcaagaaacattagagcaattttatcttaggaaagaggtctttgaatttaggctgaaagtaaattgctctgtctccatgtcctatggttatgggcaagtttggtacataaatgagaaatccatccagtggccttgcccatctcactcccaaacacctgaagaatgtaatgttatatctcctagagtagcagcatggtctccctatgaaagtccttcttctttaaggagacttctttcccttccctcctaggaggatgagtcagaatcatcaagaaaaatatgatgggcagaggcatacagtttaccattaccactagtttagaattactacttagcactttactgcctattacatagttggtgctcaacaaatgtatgataaattaatggttgagtttttctttcttctccatattcatcttccatgacaccacgaagagcaatgtttttcaagaatgttcttcaaggtttgaaagtagcctgctttagagaaactgcctactgtacagcctccaaccaagaggaaaagctgaaaaaagcatgaagggattttgttttgttttgtttgttttggttttaatatgagcattccctggcagaaaagccaggggtaatctcattgcaactaggcaatcactctcaagaaattttctaacaaataaggaggccaatttttattttattttgagacgaagtcccactctgtcacccaggttggagtgcaatggaatgatttcagctcactgcaacctccgcctcccgggttcaagtgattctcctgtctaaacttcccgagtagctgggattacaggctcccaccaccacgcccagctaattttttgtatttttagtagagatggggtttcaccattttggccagactggtctcaaactcctgacctcaagtgatccaccctcctcggcctcctaaagtgctgggattacaggcgtgagccaccacacctgacccaggaggccaatttttaaaaggttaactaatcttcatgtccaaaatgaatgttaattgttcattttggacatgaatgttaattttttttttttttttttttgagacagagtctcactctgttgcccaggctggagtccagtggcactatctccactcactgcaacttcctcctcccaggttcaagcaattatcctgcctcagcctcccaagtagctgggattacaggcccacaccatcaggcctggctaatttttgtatttttagtagagacggggtttcaccatgttggccaggctggtcttgaactcctgacctcgtgatccgccctcctcggccaaccaaagtgctgggattacaggcgtgagccaccgcgcctagccgaatgttaattgtctaaaaatttttcttctccaatgtcttctcctccacttttttcggaatttgtttcttcctaattacagcgcggtgtggaggaaactgcagctgagtgccgaaaactaggcgtcactgcgcatgcgtatgtggtagactgcagcaacagagaagagatctatcgctctctaaatcaggtgagactgcaggttcacaaatttcttcagattattttgtttcctaggacgctgacgtggaaaatgagaaaggtctttatgactgcctgatttaaattggattttagctgctaactgaagtagttatgtcaccaaggaaggatatatactttttttcttgtatgtaatccactcagctctgcccattattattgttcatattattaatcaatttcattctgatcagaagtgtgagcagtggcacagagtgactgacaaaagatttatcatcagggaatatggatcacttcctagttttgttttagtcctattaactttgcagtaattccagcttctctttaattatttcccttgtgagattttattttggtgttaatgtagtcttctgtagaaaatgtaatattaataattattatcacaattattttaaaagagtaaataccaaataatcacaatgaactaagcactctaacaaactttacattttttaattcaatccctacaataactctgtaaacttcattttacagataagcaaattatgactcagagaggttaagccagacccaggtcatgtagttattaggttatgaaaccaggatttctcaaccagcactttagaccaggtgcggtggttcacacatgtaatcccagcactttgtgaggccaaggtggaaggatcacatgagaccaagagttcaagaccagcccaggcaacatagtgagaccctatctctaaaaaaaaaaaaaaaaaaaaaaaaaaaagtttaaagaaaaacacatttttaaaaaatgaacactttaaaaatatttggtcagaatttatataggaatttatcaacataaatgttaatttcactttactgataaacttgcaaaacatgatgtgctgggtactgaaatttagatgttaaaagaacagtttatcccacctttatgacagtgttcccttggcctccacgatttgagctcaacagtctgtcttgcctgaactctgagagacctcatacaatagaagaaagactctcatctttggattatattggtcccaaaactttgagtttgaataatacacccagtgaaagtgttctttcaatttcaaaaggtgaagaaagaagtgggtgatgtaacaatcgtggtgaataatgctgggacagtatatccagccgatcttctcagcaccaaggatgaagagattaccaagacatttgaggtcaacatcctaggacatttttgggtgagtgtgagtcagaaacatttctgatttgtgcaccttctcttaagatacatgaaacttataacggagttcacatacttctggacaggaaactggccagatctttgccttaatcaagaatcattaaatttgtttgagtagaagagccacagagtctctgacacaaggacacagaattcaagtggacacaacacaccagaatgtaagctacttggtctgtcttgtccaccagtatctgacacaaagcttggcatgtaccaggagctcaacaaatgtttgtggaggtttgttaagggttgtcagtgtacatcttttcaatgctgtcacttgtgacttcatttttttccctccacaccatgattttgtaatgtgtcctcattttgtggaattttagaatggaaaggacatcagaagtaattacttggatgtatataggatcgaggacacttttggacgagactctgaggcaagtgttctagatccatggggtgctggaactgagaaatgcagctatacagacctcatataattggttagttttgtgggagatggaaatatcaacttcaactgcctttgtatagaaatttttatgattaatcttccagtgcctcaatattagtgtagaatctagggcagatctggattctagaagaaagaagaaaaaaaagagatgtgtcccccttacctttaccagctcttcacatatgtgaattggctcccatgcccaccaaactacacggagacctcatacattagctacctatagctgcataacaaattatacaaaacttagtggtttaaagcaacaatgtatgttcactatcctctcacagtttctatgggttgggaatttggaggtagcttgggttgggagttctagttctatgaatttgcataggatttattaaattcttataaaattttattgatgtttctcacaaaagaggtttttggaaaaaaagaaagacttgttttctgtaacatcaacatataatatacaatattacaaatagggagatagtgaattcaatcatgattcattagtgtggtgtagaactctcagcttacactactcaactgtcttaatacagttacacaagatttcactcttttaattagaatgataaagccccaaaccaaaaaattatatgacaccaaattatcataaggaataattttagttctgaaaactctgaatttttcccttaatattgtttagatgacatatccaaaaaaggatctatttgattccttctgaagggaaggagggggagtactgagattagtgttggcatggggcttaccataccaataaatttgtatctttatttctatcatttgtaaagaattaatcatggaatgcttggaagtattttatttcattgtataagttctctcaaatgcctttctgtcttaacaaaaataaaactacctgatttggaaacctaacgtctatgtcattgtctttcttctttctgcaatgatccttaagatcacaaaagcacttcttccatcgatgatggagagaaatcatggccacatcgtcacagtggcttcagtgtgcggccacgaagggattccttacctcatcccatattggtaagtatcacatgccagccatgttatatatttttatactttgaagggagcattacacttcaaattgttaccactggagagtcctggttcttggcatcttgaacaaagaattggacaaaactcaccaacaaagccaggaaagaatgaagcaacaaaagcagagatttattgaaaatgaaagtacgctttacagggtgggagtgggcccaagcacaggggctcaagagccaattacagaattttctggggtttaaataccccctagaggtttccactggttacttggtgtacgccctatgtaaatgaagaggatgaattaaagttacagagtcgtttactcagtgtacaccatatgtaaatggagaggatatttcctgtcatagctggagtgtttccatttgatttagttctaggaagtcagcatgaatcggccttatgttccctgcctccagaccctgttctcctgcctcaagattacaatgctgagagcagagtgatttggatttacagaatttaaatttatagtagtttagaatgattttttaaatgactttttctaaaacaatgaaaccaggttgtaattatatttaagatatttttagatttctgcaaactcctctgtagaacaatgagagaaaacagtaatgccaagcatgtttccattgtttcctggaataagaaacagaaaccccacagactgagaagcaaaacctacagaagctaaaatgaacacatgtctatgtcatggccttggtgcccaagataagacaatcagagtggtccctggatcaaaacattttacagtgtgcttgtgccatgaaagtgtgtgtgtgtgtgtgtgtgtgtgtgtgagagagagagagagagagaaaacgactctacctgactaaaagttgcagataccacactccatgcaccaccaaagacataaagggaaggaggtgagaggcgttaaggatgtactgctgtatttgccaaatatcctttcctgtaaactcttctccagatcctcataataaaattaagaggccaaagtggcaaccattgtcaagagaaaaactatcaaccattgtcaagagaataactcagttattgagagagagaggagaaatgagcagagtcctacagaagtctgtcaacacagataccagttttgtagaatttctaaatgtatttttcctgattcatatttttcaaaataaaagcagcaataaaaactgattagaaaacagtttgaagattcaatggaaaaaccttacatgtaggatggaaaactgaacattaagccaatcaatagagttatttttgttcttttgttatcattgttgtttaagaaatgagatacgttcacaattctgcttaatcatgtaagaaaatgaaaatgaattgccatttatactctcagaaaaatcacaagtggctgatttttggcttccacttgttcttaagccaaatgataccgccttctcacagaaagctgaggattggtttcactctcccttagctaacaatgcttaataattctcttacagttccagcaaatttgccgctgttggctttcacagaggtctgacatcagaacttcaggccttgggaaaaactggtatcaaaacctcatgtctctgcccagtttttgtgaatactgggttcaccaaaaatccaagcacaaggtaaggtcaaaatcaagttagaatgggtatgtggtatgataaattgatatgaaaactaatgagaaatgtttaggcaggccaactaatagaagaaaatgaagaaggaaaaataatttttcttattattattattatcttgaaattaaaggaataaagggggaaaacacattagggactagcaggaatgatcagccaccgatgaactgggatatttatttgtgtccgggagaaagcacatacatttgatcaccgttaccaccctgtctttaaaatgcaaatgttccaaggaccagcaaataaattgagtatctagctccttagtcaaggtgaatttctgcaagaactcttgtctctggtgagacaggatttgagaccacaagagaagaaaaattagtcctgaaaggagaagaaaaaagcaggaaggtgtggataagaacccgaaaattaagccatctgcttaacaaatttttctaatcctagtatatattctgctgcaggttaacaaaatatactaagcttaatgattcgaaaccaattttttactggaagggaattaatcctaaatatattcattcaaaagaactaaacaattctctgttgagtgccgcctcatttgaggatactgactcttacagcctgagttagctatgtggtctctgcagctggaatcactccctgccactggagtccttcatggtgttagaccataggtactgttgactaaagaaaaaaaaaagtttttgtttttatttttgttttttttgagacagagtctcactctgtcacccaggctggagtacagtggcgcgatctcagctcaccgcaacctccgcctttctgggttcaagcaattctccttcctcagcctcctgagtatttggattacaggcgcccaccaccacgcctggctaatttttgtatttttagtagagacggggtttcaccatgttggccaggctggtctcaaactcctgacctcaggtgtcctacctgccttggcctcctaaaatgctgggattacaggagtgagccaccatgcccggccaaaaaaataagtttttaaagaattaaaggtcatcctggctaacacagtgaaaccccgtctctactaaaaaacacaaaaaaattagccgggcgtggtggcgggcgcctgtagtcccagctgcgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaattaaaggtgttaattttatttagaagccttactgaagactacagtcggaggcctatagcctgagagcagccctttagagaggttcagttgaactgttctgatagtgggggccatgtgctctatcctgtattgtcttcaaagcatctttccagagagctgcacattgtcacagagtcagggactttgtgaaattatgctgacaaccagaagtgagtaaacgtggcttcttacatttgctacgttgtctcacagtacttaataagtatgcaatatgtaagtaaatactatagtactattgcaactcctgattgttttcttagacaaggaattgggcccaataaaaaccctcttggtaggcattcaggcttcgtgtaccatgagctttcctaagggtatcctgccactcttggggaaggcatgatagatgaggggagtaaggataatggaactctgggtacagggttcctgggggctaacttagaggtagacacaggcaatgctaaatatttgggattgattttatagaggttgctagattgtgaatttccttagtaagggctaaggcattgatatgtaatgtcacacttggctccgaggctgggttgttggatccatgtagatgaaatcagggagagaaagggcagaacggagtaatttagaaatgtattgatttgtattactctctgttggcttgctattcaaggcagtggagaactcaatcacataataatctgcagcaaaccacagatcatcccagggaatgaagttttaacattcgctggctccctaactcctcacccagcctttacattcactggctgttcagtccatgcctggacatcttaatttgaatacaacattttaaatccatttttctgtcatcatcttgcactaacagacaattctacactaagcctatgtttatgaatatttctcaagagtacatgtacacagccttcagtataaggaaaactggaagtatgacatacctccagttgtcatactccttgggcccctcttaaattctcattaaactgcaggataggcaagtcagaggtgaatctcaaatacgaaattcttaccggaaaggggttccaatccagaccccaagagagggttcttagatttctcgcaagaaataattcggggcaaggccacagtgcaaagcaaaagcaagtttattaggaaagtaaaggagtagagaacagctactccatggagaagaatggcttgagctgctccaccaagggtatttagagttacttcttgattatatgctaaacaaggggtggattattcatgagttttccgggaaaagggtgagcaattcccagaactgagatttcctcccctttttaggccatatagggtaacttcctgccattgccatggtatttgtaaactgtcatagtgctggtggaagtgtctcttagcttgctaatgtattatagttagcttataatgagcagtgaggacaaccagaggtcactttcatcaccatcttggttttggtgggttttggccggcttctttactgcaccctattttatcaacaaggtctttatgacctgaatcttgtgccaacctcctatctcatcctgtgacaaagaatgccttaacttcctgggaatgcagcccagtaggtgtcagccttattttacccagaccctattcaagatggagttgctctgatttaaacgcctctgacaaaatgacgacctcaaaacaatccagctttatggaatacctccacaagaaagaaagtatacttagctatagaattttctccttgcatccaacaggctttgagatgtcagatgtttccttcctgtcccatgattaatcctagccattcctctttcttgtctggctccactactccttaccatctaatgcctcgccaccattttgatattttgactaagtgagctatgaaacacacctactggatatgaaagtataagtttctgataacaaaacatcaacatgggatgtggaggaagtgggtagggtggcattaatgcagcaaatcctggaatattttaaatcttcattctaaatttagtaaaaatataggataattttcctgccatcatttacttataaaattaaaattttagaaaataaaaataatattttcctctttttaatcacagattatggcctgtattggagacagatgaagtcgtaagaagtctgatagatggaatacttaccaataagaaaatgatttttgttccatcgtatatcaatatctttctgagactacagaagttaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttttttttttttttttttttttttgagacagagtttcacccttgttgcccaggctggagtgcagtggcgtgatcttggctcactgcagcttctgcctcctggcttcaagtgattctcctgcctcagcctcccaagtagctgggattacaggcacctgccccctcgcccaactaactttttgtgtttgtagtagagacagggtttcaccatgttggccaggctggtctcgaactcctgacctcatgtgatccacctgcctcagcctcccaaagtgctgggattacaggcatgagccatcatgcccagccctatttgacggtttttgacgctaatgcaagtggcattttaaaaaattttatatttcccattgtttgttgtcagtatatattggatttttgtaatttgatctcatattttgcagtcttgctaaattgctaaacctctttttgctaaactcgataagcttttttttttttggtagattcctgggcctctaattttctttatgggaaagtttttaattacaaatttaatttctttaatagctacatggctattcaatttacttattaattcttggtaatgtgtgtctttcaaggaatttgtccatttcatctaagttgtagaatttctttggcataaatttgtacataacattcccttattatccttttaatgtctttagaatgtcttatttatttatttatttatttttattatatttttttgagacagagtctcgctctgttgcccaggctggagtgcagtggcacaatcttggctcactgcaagctccgccttctgggttcatgccattctcctgcctcagcctccctagttgctgggactacaggcgcctgcaaccatgcccagcttattttttttttttttttttttttttttttttttttttttttttttttagtagagacggggtttcaccctgttagccaggatggtctcgatctcctgacctggtgatccgcccgcctcagcctcccaaagtgctgggattacaggcgtgagccaccaagcccagcctatttatttatttagtagagacagtctcactttgctgcccaggcaacaaaggttttgaatgcctggcctcaagcagtcctcctgccttggcctcccaaagtgctgggattacaggcatgagccactgcacctggccaaatgaatatgctgataatatcttctttataaggatgacataagaataaaataatgtaatacaaacaaagcccctgtcactgaaaatgtatagacttcaaatgttaaagtcttagagaacagaatttatatgaaatagcaacagcaacaatttcccagaggaaatactctctcagctttcttctgaggagcagtttctaaattgaaattgtatcagtgagaagataactatactaacttcataagccttgggcctttttgaaacaaatccatataaactatgaacaaacttgaaatagaacaatttgagaacagggtacaaactgcattggtgtatcaatttcagtatttggttttagcttaaatagactgacttgagataacataaggagaaccttgacccccaagcaacatcatctcgcgagttgactaggccgggtgtggtgtctcacgcctgtaattccagcactttgggaggccacagcaggcagatcacttgaggtcaggcattcgagaccagcctggccaacatggtgaaacctcagctctactaaagatacgaaaattagcaggcatagtggcctgcacctgtaataccaggcactcgcaggagaatcccttgaacccggaaggcggagattgcagtaaaccatgattgtgccactgcactccagcctgggcaacaggagactctgtctcggaaaaataaattttttaaaaaaatgaaaaaaaataaaagttgactaaattagtgtcttggtactaagcactgtaggaagtgagtttcatggaaccccaactctcttggggcccaaagcaagtcatattaatattgaaaattacatgcatatacatgcatatgaccaaggtgataaaaacaattattctgcctgagttggagaatagtatcccagtaaaataaacaagagtctcaaagtcttttgtatcctttgaagctgtcatggtggtttgtaactaggcaacaggtatatattgttaatcttctttgcatttaattccttttatagagagacacaattttacgagcagatgcaattactagcatgaaggtttctttgtgagggtagttaaaaggcccacatgagctctcttcttatccttgtccttctttcagccagatcttccctgcccctttgctcattccatctttcacccacctacccccaaaacaaggaagtaaatcttgcattagtcaacaataccaaagtgattttcaatatgactttctctgcagaatgttattatttctgcctctttacattcacatactgtcttcctttttttttttttttttttttttttttttagattgggtctcactctgttgcccaggctggagtgcagtggcttgatctcagctcactgtaacctccacctcctgagttcaagcaattctcctgcctcagcctcctgagtagctgggattacaggcatgtgccaccacacctggctagtttttttgtatttttagtagagacagggtttcaccatgttggtcaagctggtctcgaactcctgacctcatgatctgaccacctgtgcctctcaaagtgctgggattacaggcgtgagccaccgggccagccactctcttcctttcagttgcctactcatctcttatgcattcctggacatcagttgtccttttgaagctttcctccactatcccagcccatgtgaatcctccttccagttatagcccttaattctagatggctgatatttttcaataattgttttaagatgaccattttagcctatcagctaaacaatatcaaagacaatagctatttttcaagtactttagtttaccttattatagagtgcataatagatattcagtaaatagtaaaggagaggtgaaggcttgcatagaatggattctggtggtgtctcttggtgagcttttagcatcaagattaatcagcagtttcagcaatgagctcagaccttcagttttagatctttactcatatcagataagagagtgagaagagtggtatgtatcagtgctttatttatatttgcatccaatttgaactatgaatattacaaaggtgcacacataggttcagacagattgatttaaaatgaccaaagatgacctgtcgtaagcaacctgggtatcttaagatgcactccttggagagggaatgttcctaaaaacattttcagagggacgaactgtatgaaattcagtaaaacataaatcatgaggaaaactgattactctctttttgacatgaaatgagagttttaatgcatggttacgattattaacgtactccgctgcaagacgttaataaagttactgttttgcaggctagaatgtcttgatgctgtaatcagaacacactttttcccctttcttccagcttcaaatgcagattcataattgggctgacttctaataactgcaatgttttctgccttgggcttgcagcagaagcctgacaaaatagtgtttgtttaggcaataatttatttatttatttattgagatggagtttcattcttgtcgcccaggctggagtgcaatggcgtgatctcggctcactgcaacctctgtgttcaggcaataatttagactttaccttacttgtgattactatagcaattactatagccacaaggcataattttactgtctcatttcaattttatgaatttgaatgtttttacacttttcctaatgaagtccactatgaagttatgtcaaaaaaaaaaaagaaaaagaaagatgcacacgtaaaagagaggtggttgcaagagaagaaaagaacggaggaaagttaaacgcaaaccagataactctcagcgtattctaaatgaccaaaaacagaactctgttgtcaaagattttaaatggaaaatttttcaatttttttttcttttttgtacaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 17 - DNA, 2280 bp, Homo sapiens
  misc_feature (1)..(275): /note="Exon 1"
  misc_feature (276)..(383): /note="Exon 2"
  misc_feature (384)..(515): /note="Exon 3"
  misc_feature (516)..(622): /note="Exon 4"
  misc_feature (623)..(760): /note="Exon 5"
  misc_feature (761)..(2280): /note="Exon 7"
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 18 - DNA, 2398 bp, Homo sapiens
  misc_feature (1)..(275): /note="Exon 1"
  misc_feature (276)..(383): /note="Exon 2"
  misc_feature (384)..(515): /note="Exon 3"
  misc_feature (516)..(622): /note="Exon 4"
  misc_feature (623)..(760): /note="Exon 5"
  misc_feature (761)..(878): /note="Exon 6v2 - includes additional residue 878 at 3' end"
  misc_feature (879)..(2398): /note="Exon 7"
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 19 - DNA, 2469 bp, Homo sapiens
  misc_feature (1)..(275): /note="Exon 1"
  misc_feature (276)..(383): /note="Exon 2"
  misc_feature (384)..(515): /note="Exon 3"
  misc_feature (516)..(587): /note="Exon 3'"
  misc_feature (588)..(694): /note="Exon 4"
  misc_feature (695)..(832): /note="Exon 5"
  misc_feature (833)..(949): /note="Exon 6v1"
  misc_feature (950)..(2469): /note="Exon 7"
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggaatggaaaggacatcagaagtaattacttggatgtatataggatcgaggacacttttggacgagactctgagatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 20 - DNA, 1715 bp, Homo sapiens
  misc_feature (1)..(275): /note="Exon 1"
  misc_feature (276)..(383): /note="Exon 2"
  misc_feature (384)..(515): /note="Exon 3"
  misc_feature (516)..(622): /note="Exon 4"
  misc_feature (623)..(760): /note="Exon 5"
  misc_feature (761)..(1715): /note="Exon 6v3"
  misc_feature (878)..(1715): /note="Read-through from exon 6 into intron 6"
  misc_feature (1716)..(1715): /note="Read-through from exon 6 into intron 6"
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagttaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttt

SEQ ID NO: 21 - DNA, 2290 bp, Homo sapiens
  misc_feature (1)..(275): /note="Exon 1"
  misc_feature (276)..(407): /note="Exon 3"
  misc_feature (408)..(514): /note="Exon 4"
  misc_feature (515)..(652): /note="Exon 5"
  misc_feature (653)..(770): /note="Exon 6v2 - includes additional residue 770 at 3' end"
  misc_feature (771)..(2290): /note="Exon 7"
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 22 - DNA, 2470 bp, Homo sapiens
  misc_feature (1)..(275): /note="Exon 1"
  misc_feature (276)..(383): /note="Exon 2"
  misc_feature (384)..(515): /note="Exon 3"
  misc_feature (516)..(587): /note="Exon 3'"
  misc_feature (588)..(694): /note="Exon 4"
  misc_feature (695)..(832): /note="Exon 5"
  misc_feature (833)..(950): /note="Exon 6v2 - includes additional residue 950 at 3' end"
  misc_feature (951)..(2470): /note="Exon 7"
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggaatggaaaggacatcagaagtaattacttggatgtatataggatcgaggacacttttggacgagactctgagatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 23 - DNA, 1714 bp, Homo sapiens
  misc_feature (1)..(275): /note="Exon 1"
  misc_feature (276)..(383): /note="Exon 2"
  misc_feature (384)..(515): /note="Exon 3"
  misc_feature (516)..(622): /note="Exon 4"
  misc_feature (623)..(760): /note="Exon 5"
  misc_feature (761)..(1714): /note="Exon 6v4"
  misc_feature (878)..(1714): /note="Read-through from exon 6 into intron 6"
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttt

SEQ ID NO: 24 - RNA, 21 nt, Artificial Sequence
  source: /note="Description of Artificial Sequence: Synthetic oligonucleotide"
cugcagcugagugccgaaaau

SEQ ID NO: 25 - RNA, 21 nt, Artificial Sequence
  source: /note="Description of Artificial Sequence: Synthetic oligonucleotide"
cagcugagugccgaaaacuau

SEQ ID NO: 26 - RNA, 21 nt, Artificial Sequence
  source: /note="Description of Artificial Sequence: Synthetic oligonucleotide"
agcugagugccgaaaacuagu

SEQ ID NO: 27 - RNA, 21 nt, Artificial Sequence
  source: /note="Description of Artificial Sequence: Synthetic oligonucleotide"
gcugagugccgaaaacuaggu

SEQ ID NO: 28 - RNA, 21 nt, Artificial Sequence
  source: /note="Description of Artificial Sequence: Synthetic oligonucleotide"
cugagugccgaaaacuaggcu

SEQ ID NO: 29 - RNA, 21 nt, Artificial Sequence
  source: /note="Description of Artificial Sequence: Synthetic oligonucleotide"
gagugccgaaaacuaggcguu

SEQ ID NO: 30 - RNA, 21 nt, Artificial Sequence
  source: /note="Description of Artificial Sequence: Synthetic oligonucleotide"
gugccgaaaacuaggcgucau

SEQ ID NO: 31 - RNA, 21 nt, Artificial Sequence
  source: /note="Description of Artificial Sequence: Synthetic oligonucleotide"
gccgaaaacuaggcgucacuu

SEQ ID NO: 32 - RNA, 21 nt, Artificial Sequence
  source: /note="Description of Artificial Sequence: Synthetic oligonucleotide"
ccgaaaacuaggcgucacugu

SEQ ID NO: 33 - RNA, 21 nt, Artificial Sequence
  source: /note="Description of Artificial Sequence: Synthetic oligonucleotide"
acuaggcgucacugcgcaugu

SEQ ID NO: 34 - RNA, 21 nt, Artificial Sequence
  source: /note="Description of Artificial Sequence: Synthetic oligonucleotide"
gaucuaucgcucucuaaauca

SEQ ID NO: 35 - RNA, 21 nt, Artificial Sequence
  source: /note="Description of Artificial Sequence: Synthetic oligonucleotide"
cuaucgcucucuaaaucaggu

SEQ ID NO: 36 - RNA, 21 nt, Artificial Sequence
  source: /note="Description of Artificial Sequence: Synthetic oligonucleotide"
aucgcucucuaaaucagguga

SEQ ID NO: 37 - RNA, 21 nt, Artificial Sequence
  source: /note="Description of Artificial Sequence: Synthetic oligonucleotide"
ucgcucucuaaaucaggugaa

SEQ ID NO: 38 - RNA, 21 nt, Artificial Sequence
  source: /note="Description of Artificial Sequence: Synthetic oligonucleotide"
ucucuaaaucaggugaagaaa

SEQ ID NO: 39 - RNA, 21 nt, Artificial Sequence
  source: /note="Description of Artificial Sequence: Synthetic oligonucleotide"
guggugaauaaugcugggaca

SEQ ID NO: 40 - RNA, 21 nt, Artificial Sequence
  source: /note="Description of Artificial Sequence: Synthetic oligonucleotide"
gaauaaugcugggacaguaua

SEQ ID NO: 41 - RNA, 21 nt, Artificial Sequence
  source: /note="Description of Artificial Sequence: Synthetic oligonucleotide"
aauaaugcugggacaguauau

SEQ ID NO: 42 - RNA, 21 nt, Artificial Sequence
  source: /note="Description of Artificial Sequence: Synthetic oligonucleotide"
gggacaguauauccagccgau

SEQ ID NO: 43 - RNA, 21 nt, Artificial Sequence
  source: /note="Description of Artificial Sequence: Synthetic oligonucleotide"
gacaguauauccagccgaucu

SEQ ID NO: 44 - RNA, 21 nt, Artificial Sequence
  source: /note="Description of Artificial Sequence: Synthetic oligonucleotide"
acaguauauccagccgaucuu

SEQ ID NO: 45 - RNA, 21 nt, Artificial Sequence
  source: /note="Description of Artificial Sequence: Synthetic oligonucleotide"
aguauauccagccgaucuucu

SEQ ID NO: 46 - RNA, 21 nt, Artificial Sequence
  source: /note="Description of Artificial Sequence: Synthetic oligonucleotide"
aucuaucgcucucuaaaucau

SEQ ID NO: 47 - RNA, 21 nt, Artificial Sequence
  source: /note="Description of Artificial Sequence: Synthetic oligonucleotide"
uaucgcucucuaaaucagguu

SEQ ID NO: 48 - RNA, 21 nt, Artificial Sequence
  source: /note="Description of Artificial Sequence: Synthetic oligonucleotide"
cgcucucuaaaucaggugaau

SEQ ID NO: 49 - RNA, 21 nt, Artificial Sequence
  source: /note="Description of Artificial Sequence: Synthetic oligonucleotide"
cguggugaauaaugcugggau

SEQ ID NO: 50 - RNA, 21 nt, Artificial Sequence
  source: /note="Description of Artificial Sequence: Synthetic oligonucleotide"
uggugaauaaugcugggacau

SEQ ID NO: 51 - RNA, 21 nt, Artificial Sequence
  source: /note="Description of Artificial Sequence: Synthetic oligonucleotide"
augcugggacaguauauccau

SEQ ID NO: 52 - RNA, 21 nt, Artificial Sequence
  source: /note="Description of Artificial Sequence: Synthetic oligonucleotide"
ugcugggacaguauauccagu

SEQ ID NO: 53 - RNA, 21 nt, Artificial Sequence
  source: /note="Description of Artificial Sequence: Synthetic oligonucleotide"
gcugggacaguauauccagcu

SEQ ID NO: 54 - RNA, 21 nt, Artificial Sequence
  source: /note="Description of Artificial Sequence: Synthetic oligonucleotide"
cugggacaguauauccagccu

SEQ ID NO: 55 - RNA, 21 nt, Artificial Sequence
  source: /note="Description of Artificial Sequence: Synthetic oligonucleotide"
ggacaguauauccagccgauu

SEQ ID NO: 56 - RNA, 21 nt, Artificial Sequence
  source: /note="Description of Artificial Sequence: Synthetic oligonucleotide"
caguauauccagccgaucuuu

SEQ ID NO: 57 - RNA, 21 nt, Artificial Sequence
  source: /note="Description of Artificial Sequence: Synthetic oligonucleotide"
ccaaggaugaagagauuacca

SEQ ID NO: 58 - RNA, 21 nt, Artificial Sequence
  source: /note="Description of Artificial Sequence: Synthetic oligonucleotide"
caaggaugaagagauuaccaa

SEQ ID NO: 59 - RNA, 21 nt, Artificial Sequence
  source: /note="Description of Artificial Sequence: Synthetic oligonucleotide"
uuugaggucaacauccuagga

SEQ ID NO: 60 - RNA, 21 nt, Artificial Sequence
  source: /note="Description of Artificial Sequence: Synthetic oligonucleotide"
ugaggucaacauccuaggaca

SEQ ID NO: 61 - RNA, 21 nt, Artificial Sequence
  source: /note="Description of Artificial Sequence: Synthetic oligonucleotide"
gaggucaacauccuaggacau

SEQ ID NO: 62 - RNA, 21 nt, Artificial Sequence
  source: /note="Description of Artificial Sequence: Synthetic oligonucleotide"
ggucaacauccuaggacauuu

SEQ ID NO: 63 - RNA, 21 nt, Artificial Sequence
  source: /note="Description of Artificial Sequence: Synthetic oligonucleotide"
gucaacauccuaggacauuuu

SEQ ID NO: 64 - RNA, 21 nt, Artificial Sequence
  source: /note="Description of Artificial Sequence: Synthetic oligonucleotide"
acauccuaggacauuuuugga

SEQ ID NO: 65 - RNA, 21 nt, Artificial Sequence
  source: /note="Description of Artificial Sequence: Synthetic oligonucleotide"
cauccuaggacauuuuuggau

SEQ ID NO: 66 - RNA, 21 nt, Artificial Sequence
  source: /note="Description of Artificial Sequence: Synthetic oligonucleotide"
uccuaggacauuuuuggauca

SEQ ID NO: 67 - RNA, 21 nt, Artificial Sequence
  source: /note="Description of Artificial Sequence: Synthetic oligonucleotide"
aggacauuuuuggaucacaaa

SEQ ID NO: 68 - RNA, 21 nt, Artificial Sequence
  source: /note="Description of Artificial Sequence: Synthetic oligonucleotide"
ggacauuuuuggaucacaaaa

SEQ ID NO: 69 - RNA, 21 nt, Artificial Sequence
  source: /note="Description of Artificial Sequence: Synthetic oligonucleotide"
uuuuuggaucacaaaagcacu

SEQ ID NO: 70 - RNA, 21 nt, Artificial Sequence
  source: /note="Description of Artificial Sequence: Synthetic oligonucleotide"
uggaucacaaaagcacuucuu

SEQ ID NO: 71 - RNA, 21 nt, Artificial Sequence
  source: /note="Description of Artificial Sequence: Synthetic oligonucleotide"
caaaagcacuucuuccaucga

SEQ ID NO: 72 - RNA, 21 nt, Artificial Sequence
  source: /note="Description of Artificial Sequence: Synthetic oligonucleotide"
aaaagcacuucuuccaucgau

SEQ ID NO: 73 - RNA, 21 nt, Artificial Sequence
  source: /note="Description of Artificial Sequence: Synthetic oligonucleotide"
aagcacuucuuccaucgauga

SEQ ID NO: 74 - RNA, 21 nt, Artificial Sequence
  source: /note="Description of Artificial Sequence: Synthetic oligonucleotide"
agcacuucuuccaucgaugau

SEQ ID NO: 75 - RNA, 21 nt, Artificial Sequence
  source: /note="Description of Artificial Sequence: Synthetic oligonucleotide"
ggagagaaaucauggccacau

SEQ ID NO: 76 - RNA, 21 nt, Artificial Sequence
  source: /note="Description of Artificial Sequence: Synthetic oligonucleotide"
accaaggaugaagagauuacu

SEQ ID NO: 77 - RNA, 21 nt, Artificial Sequence
  source: /note="Description of Artificial Sequence: Synthetic oligonucleotide"
agacauuugaggucaacaucu

SEQ ID NO: 78 - RNA, 21 nt, Artificial Sequence
  source: /note="Description of Artificial Sequence: Synthetic oligonucleotide"
cauuugaggucaacauccuau

SEQ ID NO: 79 - RNA, 21 nt, Artificial Sequence
  source: /note="Description of Artificial Sequence: Synthetic oligonucleotide"
auuugaggucaacauccuagu

SEQ ID NO: 80 - RNA, 21 nt, Artificial Sequence
  source: /note="Description of Artificial Sequence: Synthetic oligonucleotide"
uugaggucaacauccuaggau

SEQ ID NO: 81 - RNA, 21 nt, Artificial Sequence
  source: /note="Description of Artificial Sequence: Synthetic oligonucleotide"
caacauccuaggacauuuuug

SEQ ID NO: 82 - RNA, 21 nt, Artificial Sequence
  source: /note="Description of Artificial Sequence: Synthetic oligonucleotide"
aacauccuaggacauuuuugu

SEQ ID NO: 83 - RNA, 21 nt, Artificial Sequence
  source: /note="Description of Artificial Sequence: Synthetic oligonucleotide"
auccuaggacauuuuuggauu

SEQ ID NO: 84 - RNA, 21 nt, Artificial Sequence
  source: /note="Description of Artificial Sequence: Synthetic oligonucleotide"
ccuaggacauuuuuggaucau

SEQ ID NO: 85 - RNA, 21 nt, Artificial Sequence
  source: /note="Description of Artificial Sequence: Synthetic oligonucleotide"
gacauuuuuggaucacaaaau

SEQ ID NO: 86 - RNA, 21 nt, Artificial Sequence
  source: /note="Description of Artificial Sequence: Synthetic oligonucleotide"
ggaucacaaaagcacuucuuu

SEQ ID NO: 87 - RNA, 21 nt, Artificial Sequence
  source: /note="Description of Artificial Sequence: Synthetic oligonucleotide"
cacaaaagcacuucuuccauu

SEQ ID NO: 88 - RNA, 21 nt, Artificial Sequence
  source: /note="Description of Artificial Sequence: Synthetic oligonucleotide"
acaaaagcacuucuuccaucu

SEQ ID NO: 89 - RNA, 21 nt, Artificial Sequence
  source: /note="Description of Artificial Sequence: Synthetic oligonucleotide"
aaagcacuucuuccaucgauu

SEQ ID NO: 90 - RNA, 21 nt, Artificial Sequence
  source: /note="Description of Artificial Sequence: Synthetic oligonucleotide"
gcacuucuuccaucgaugauu

SEQ ID NO: 91 - RNA, 21 nt, Artificial Sequence
  source: /note="Description of Artificial Sequence: Synthetic oligonucleotide"
agaaaucauggccacaucguu

SEQ ID NO: 92 - RNA, 21 nt, Artificial Sequence
  source: /note="Description of Artificial Sequence: Synthetic oligonucleotide"
aaaucauggccacaucgucau

SEQ ID NO: 93 - RNA, 21 nt, Artificial Sequence
  source: /note="Description of Artificial Sequence: Synthetic oligonucleotide"
uuccuuaccucaucccauauu

SEQ ID NO: 94 - RNA, 21 nt, Artificial Sequence
  source: /note="Description of Artificial Sequence: Synthetic oligonucleotide"
accucaucccauauuguucca

SEQ ID NO: 95 - RNA, 21 nt, Artificial Sequence
  source: /note="Description of Artificial Sequence: Synthetic oligonucleotide"
ucaucccauauuguuccagca

SEQ ID NO: 96 - RNA, 21 nt, Artificial Sequence
  source: /note="Description of Artificial Sequence: Synthetic oligonucleotide"
caucccauauuguuccagcaa

SEQ ID NO: 97 - RNA, 21 nt, Artificial Sequence
  source: /note="Description of Artificial Sequence: Synthetic oligonucleotide"
ucccauauuguuccagcaaau

SEQ ID NO: 98 - RNA, 21 nt, Artificial Sequence
  source: /note="Description of Artificial Sequence: Synthetic oligonucleotide"
cccauauuguuccagcaaauu

SEQ ID NO: 99 - RNA, 21 nt, Artificial Sequence
  source: /note="Description of Artificial Sequence: Synthetic oligonucleotide"
uguuggcuuucacagaggucu

SEQ ID NO: 100 - RNA, 21 nt, Artificial Sequence
  source: /note="Description of Artificial Sequence: Synthetic oligonucleotide"
ggcuuucacagaggucugaca

SEQ ID NO: 101 - RNA, 21 nt, Artificial Sequence
  source: /note="Description of Artificial Sequence: Synthetic oligonucleotide"
gcuuucacagaggucugacau

SEQ ID NO: 102 - RNA, 21 nt, Artificial Sequence
  source: /note="Description of Artificial Sequence: Synthetic oligonucleotide"
cacagaggucugacaucagaa

SEQ ID NO: 103 - RNA, 21 nt, Artificial Sequence
  source: /note="Description of Artificial Sequence: Synthetic oligonucleotide"
aggucugacaucagaacuuca

SEQ ID NO: 104 - RNA, 21 nt, Artificial Sequence
  source: /note="Description of Artificial Sequence: Synthetic oligonucleotide"
uccuuaccucaucccauauuu

SEQ ID NO: 105 - RNA, 21 nt, Artificial Sequence
  source: /note="Description of Artificial Sequence: Synthetic oligonucleotide"
uucacagaggucugacaucau

SEQ ID NO: 106 - RNA, 21 nt, Artificial Sequence
  source: /note="Description of Artificial Sequence: Synthetic oligonucleotide"
uugggaaaaacugguaucaaa

SEQ ID NO: 107 - RNA, 21 nt, Artificial Sequence
  source: /note="Description of Artificial Sequence: Synthetic oligonucleotide"
acugguaucaaaaccucaugu

SEQ ID NO: 108 - RNA, 21 nt, Artificial Sequence
  source: /note="Description of Artificial Sequence: Synthetic oligonucleotide"
ugguaucaaaaccucaugucu

SEQ ID NO: 109 - RNA, 21 nt, Artificial Sequence
  source: /note="Description of Artificial Sequence: Synthetic oligonucleotide"
cucugcccaguuuuugugaau

SEQ ID NO: 110 - RNA, 21 nt, Artificial Sequence
  source: /note="Description of Artificial Sequence: Synthetic oligonucleotide"
uuuuugugaauacuggguuca

SEQ ID NO: 111 - RNA, 21 nt, Artificial Sequence
  source: /note="Description of Artificial Sequence: Synthetic oligonucleotide"
uugugaauacuggguucacca

SEQ ID NO: 112 - RNA, 21 nt, Artificial Sequence
  source: /note="Description of Artificial Sequence: Synthetic oligonucleotide"
ugugaauacuggguucaccaa

SEQ ID NO: 113 - RNA, 21 nt, Artificial Sequence
  source: /note="Description of Artificial Sequence: Synthetic oligonucleotide"
ugaauacuggguucaccaaaa

SEQ ID NO: 114 - RNA, 21 nt, Artificial Sequence
  source: /note="Description of Artificial Sequence: Synthetic oligonucleotide"
gaauacuggguucaccaaaaa

SEQ ID NO: 115 - RNA, 21 nt, Artificial Sequence
  source: /note="Description of Artificial Sequence: Synthetic oligonucleotide"
aauacuggguucaccaaaaau

SEQ ID NO: 116 - RNA, 21 nt, Artificial Sequence
  source: /note="Description of Artificial Sequence: Synthetic oligonucleotide"
aaaaauccaagcacaagauua

SEQ ID NO: 117 - RNA, 21 nt, Artificial Sequence
  source: /note="Description of Artificial Sequence: Synthetic oligonucleotide"
aaaauccaagcacaagauuau

SEQ ID NO: 118 - RNA, 21 nt, Artificial Sequence
  source: /note="Description of Artificial Sequence: Synthetic oligonucleotide"
agcacaagauuauggccugua

SEQ ID NO: 119 - RNA, 21 nt, Artificial Sequence
  source: /note="Description of Artificial Sequence: Synthetic oligonucleotide"
gcacaagauuauggccuguau

SEQ ID NO: 120 - RNA, 21 nt, Artificial Sequence
  source: /note="Description of Artificial Sequence: Synthetic oligonucleotide"
cacaagauuauggccuguauu

SEQ ID NO: 121 - RNA, 21 nt, Artificial Sequence
  source: /note="Description of Artificial Sequence: Synthetic oligonucleotide"
aagauuauggccuguauugga

SEQ ID NO: 122 - RNA, 21 nt, Artificial Sequence
  source: /note="Description of Artificial Sequence: Synthetic oligonucleotide"
gauuauggccuguauuggaga

SEQ ID NO: 123 - RNA, 21 nt, Artificial Sequence
  source: /note="Description of Artificial Sequence: Synthetic oligonucleotide"
uuauggccuguauuggagaca

SEQ ID NO: 124 - RNA, 21 nt, Artificial Sequence
  source: /note="Description of Artificial Sequence: Synthetic oligonucleotide"
uggccuguauuggagacagau

SEQ ID NO: 125 - RNA, 21 nt, Artificial Sequence
  source: /note="Description of Artificial Sequence: Synthetic oligonucleotide"
gccuguauuggagacagauga

SEQ ID NO: 126 - RNA, 21 nt, Artificial Sequence
  source: /note="Description of Artificial Sequence: Synthetic oligonucleotide"
cugguaucaaaaccucauguu

SEQ ID NO: 127 - RNA, 21 nt, Artificial Sequence
  source: /note="Description of Artificial Sequence: Synthetic oligonucleotide"
gguaucaaaaccucaugucuu

SEQ ID NO: 128 - RNA, 21 nt, Artificial Sequence
  source: /note="Description of Artificial Sequence: Synthetic oligonucleotide"
ucaaaaccucaugucucugcu

SEQ ID NO: 129 - RNA, 21 nt, Artificial Sequence
  source: /note="Description of Artificial Sequence: Synthetic oligonucleotide"
cccaguuuuugugaauacugu

SEQ ID NO: 130 - RNA, 21 nt, Artificial Sequence
  source: /note="Description of Artificial Sequence: Synthetic oligonucleotide"
uuuugugaauacuggguucau

SEQ ID NO: 131 - RNA, 21 nt, Artificial Sequence
  source: /note="Description of Artificial Sequence: Synthetic oligonucleotide"
uuugugaauacuggguucacu

SEQ ID NO: 132 - RNA, 21 nt, Artificial Sequence
  source: /note="Description of Artificial Sequence: Synthetic oligonucleotide"
auacuggguucaccaaaaauu

SEQ ID NO: 133 - RNA, 21 nt, Artificial Sequence
  source: /note="Description of Artificial Sequence: Synthetic oligonucleotide"
uacuggguucaccaaaaaucu

SEQ ID NO: 134 - RNA, 21 nt, Artificial Sequence
  source: /note="Description of Artificial Sequence: Synthetic oligonucleotide"
caccaaaaauccaagcacaau

SEQ ID NO: 135 - RNA, 21 nt, Artificial Sequence
  source: /note="Description of Artificial Sequence: Synthetic oligonucleotide"
aaauccaagcacaagauuauu

SEQ ID NO: 136 - RNA, 21 nt, Artificial Sequence
  source: /note="Description of Artificial Sequence: Synthetic oligonucleotide"
aauccaagcacaagauuaugu

SEQ ID NO: 137 - RNA, 21 nt, Artificial Sequence
  source: /note="Description of Artificial Sequence: Synthetic oligonucleotide"
auccaagcacaagauuauggu

SEQ ID NO: 138 - RNA, 21 nt, Artificial Sequence
  source: /note="Description of Artificial Sequence: Synthetic oligonucleotide"
uccaagcacaagauuauggcu

SEQ ID NO: 139 - RNA, 21 nt, Artificial Sequence
  source: /note="Description of Artificial Sequence: Synthetic oligonucleotide"
acaagauuauggccuguauuu

SEQ ID NO: 140 - RNA, 21 nt, Artificial Sequence
  source: /note="Description of Artificial Sequence: Synthetic oligonucleotide"
caagauuauggccuguauugu

SEQ ID NO: 141 - RNA, 21 nt, Artificial Sequence
  source: /note="Description of Artificial Sequence: Synthetic oligonucleotide"
auuauggccuguauuggagau

SEQ ID NO: 142 - RNA, 21 nt, Artificial Sequence
  source: /note="Description of Artificial Sequence: Synthetic oligonucleotide"
ggccuguauuggagacagauu

SEQ ID NO: 143 - RNA, 21 nt, Artificial Sequence
  source: /note="Description of Artificial Sequence: Synthetic oligonucleotide"
guaagaagucugauagaugga

SEQ ID NO: 144 - RNA, 21 nt, Artificial Sequence
  source: /note="Description of Artificial Sequence: Synthetic oligonucleotide"
uaagaagucugauagauggaa

SEQ ID NO: 145 - RNA, 21 nt, Artificial Sequence
  source: /note="Description of Artificial Sequence: Synthetic oligonucleotide"
aagaagucugauagauggaau

SEQ ID NO: 146 - RNA, 21 nt, Artificial Sequence
  source: /note="Description of Artificial Sequence: Synthetic oligonucleotide"
agaagucugauagauggaaua

SEQ ID NO: 147 - RNA, 21 nt, Artificial Sequence
  source: /note="Description of Artificial Sequence: Synthetic oligonucleotide"
aagucugauagauggaauacu

SEQ ID NO: 148 - RNA, 21 nt, Artificial Sequence
  source: /note="Description of Artificial Sequence: Synthetic oligonucleotide"
agauggaauacuuaccaauaa

SEQ ID NO: 149 - RNA, 21 nt, Artificial Sequence
  source: /note="Description of Artificial Sequence: Synthetic oligonucleotide"
auggaauacuuaccaauaaga

SEQ ID NO: 150 - RNA, 21 nt, Artificial Sequence
  source: /note="Description of Artificial Sequence: Synthetic oligonucleotide"
uggaauacuuaccaauaagaa

SEQ ID NO: 151 - RNA, 21 nt, Artificial Sequence
  source: /note="Description of Artificial Sequence: Synthetic oligonucleotide"
ggaauacuuaccaauaagaaa

SEQ ID NO: 152 - RNA, 21 nt, Artificial Sequence
  source: /note="Description of Artificial Sequence: Synthetic oligonucleotide"
gaauacuuaccaauaagaaaa

SEQ ID NO: 153 - RNA, 21 nt, Artificial Sequence
  source: /note="Description of Artificial Sequence: Synthetic oligonucleotide"
aauacuuaccaauaagaaaau

SEQ ID NO: 154 - RNA, 21 nt, Artificial Sequence
  source: /note="Description of Artificial Sequence: Synthetic oligonucleotide"
uuucuuccugaacgcgccuca

SEQ ID NO: 155 - RNA, 21 nt, Artificial Sequence
  source: /note="Description of Artificial Sequence: Synthetic oligonucleotide"
gauuuuaaaucguaugcagaa

SEQ ID NO: 156 - RNA, 21 nt, Artificial Sequence
  source: /note="Description of Artificial Sequence: Synthetic oligonucleotide"
uuuuaaaucguaugcagaaua

SEQ ID NO: 157 - RNA, 21 nt, Artificial Sequence
  source: /note="Description of Artificial Sequence: Synthetic oligonucleotide"
aaaucguaugcagaauauuca

SEQ ID NO: 158 - RNA, 21 nt, Artificial Sequence
  source: /note="Description of Artificial Sequence: Synthetic oligonucleotide"
aucguaugcagaauauucaau

SEQ ID NO: 159 - RNA, 21 nt, Artificial Sequence
  source: /note="Description of Artificial Sequence: Synthetic oligonucleotide"
ucguaugcagaauauucaauu

SEQ ID NO: 160 - RNA, 21 nt, Artificial Sequence
  source: /note="Description of Artificial Sequence: Synthetic oligonucleotide"
cguaugcagaauauucaauuu

SEQ ID NO: 161 - RNA, 21 nt, Artificial Sequence
  source: /note="Description of Artificial Sequence: Synthetic oligonucleotide"
augcagaauauucaauuugaa

SEQ ID NO: 162 - RNA, 21 nt, Artificial Sequence
  source: /note="Description of Artificial Sequence: Synthetic oligonucleotide"
gaagucugauagauggaauau

SEQ ID NO: 163 - RNA, 21 nt, Artificial Sequence
  source: /note="Description of Artificial Sequence: Synthetic oligonucleotide"
ucugauagauggaauacuuau

SEQ ID NO: 164 - RNA, 21 nt, Artificial Sequence
  source: /note="Description of Artificial Sequence: Synthetic oligonucleotide"
gauggaauacuuaccaauaau

SEQ ID NO: 165 - RNA, 21 nt, Artificial Sequence
  source: /note="Description of Artificial Sequence: Synthetic oligonucleotide"
acagaaguuucuuccugaacu

SEQ ID NO: 166 - RNA, 21 nt, Artificial Sequence
  source: /note="Description of Artificial Sequence: Synthetic oligonucleotide"
agaaguuucuuccugaacgcu

SEQ ID NO: 167 - RNA, 21 nt, Artificial Sequence
  source: /note="Description of Artificial Sequence: Synthetic oligonucleotide"
aaguuucuuccugaacgcgcu

SEQ ID NO: 168 - RNA, 21 nt, Artificial Sequence
  source: /note="Description of Artificial Sequence: Synthetic oligonucleotide"
guuucuuccugaacgcgccuu

SEQ ID NO: 169 - RNA, 21 nt, Artificial Sequence
  source: /note="Description of Artificial Sequence: Synthetic oligonucleotide"
ucuuccugaacgcgccucagu

SEQ ID NO: 170 - RNA, 21 nt, Artificial Sequence
  source: /note="Description of Artificial Sequence: Synthetic oligonucleotide"
gcagaauauucaauuugaagu

SEQ ID NO: 171 - RNA, 21 nt, Artificial Sequence
  source: /note="Description of Artificial Sequence: Synthetic oligonucleotide"
aauauucaauuugaagcaguu

SEQ ID NO: 172 - RNA, 21 nt, Artificial Sequence
  source: /note="Description of Artificial Sequence: Synthetic oligonucleotide"
uauucaauuugaagcaguggu

SEQ ID NO: 173 - RNA, 21 nt, Artificial Sequence
  source: /note="Description of Artificial Sequence: Synthetic oligonucleotide"
gauguaugcaugauaaugaua

SEQ ID NO: 174 - RNA, 21 nt, Artificial Sequence
  source: /note="Description of Artificial Sequence: Synthetic oligonucleotide"
caaugcugcaaagcuuuauuu

SEQ ID NO: 175 - RNA, 21 nt, Artificial Sequence
  source: /note="Description of Artificial Sequence: Synthetic oligonucleotide"
aaagcuuuauuucacauuuuu

SEQ ID NO: 176 - RNA, 21 nt, Artificial Sequence
  source: /note="Description of Artificial Sequence: Synthetic oligonucleotide"
aauuugaagcagugguuggcu

SEQ ID NO: 177 - RNA, 21 nt, Artificial Sequence
  source: /note="Description of Artificial Sequence: Synthetic oligonucleotide"
aaugcugcaaagcuuuauuuc

SEQ ID NO: 178 - RNA, 21 nt, Artificial Sequence
  source: /note="Description of Artificial Sequence: Synthetic oligonucleotide"
ugcugcaaagcuuuauuucau

SEQ ID NO: 179 - RNA, 21 nt, Artificial Sequence
  source: /note="Description of Artificial Sequence: Synthetic oligonucleotide"
aaaaacauugguuuggcacua

SEQ ID NO: 180 - RNA, 21 nt, Artificial Sequence
  source: /note="Description of Artificial Sequence: Synthetic oligonucleotide"
agauuaauuaccugucuuccu

SEQ ID NO: 181 - RNA, 21 nt, Artificial Sequence
  source: /note="Description of Artificial Sequence: Synthetic oligonucleotide"
auuaauuaccugucuuccugu

SEQ ID NO: 182 - RNA, 21 nt, Artificial Sequence
  source: /note="Description of Artificial Sequence: Synthetic oligonucleotide"
uaauuaccugucuuccuguuu

SEQ ID NO: 183 - RNA, 21 nt, Artificial Sequence
  source: /note="Description of Artificial Sequence: Synthetic oligonucleotide"
uaccugucuuccuguuucuca

SEQ ID NO: 184 - RNA, 21 nt, Artificial Sequence
  source: /note="Description of Artificial Sequence: Synthetic oligonucleotide"
accugucuuccuguuucucaa

SEQ ID NO: 185 - RNA, 21 nt, Artificial Sequence
  source: /note="Description of Artificial Sequence: Synthetic oligonucleotide"
ucuuccuguuucucaagaaua

SEQ ID NO: 186 - RNA, 21 nt, Artificial Sequence
  source: /note="Description of Artificial Sequence: Synthetic oligonucleotide"
uuuuccuuucaugccucuuaa

SEQ ID NO: 187 - RNA, 21 nt, Artificial Sequence
  source: /note="Description of Artificial Sequence: Synthetic oligonucleotide"
uccuuucaugccucuuaaaaa

SEQ ID NO: 188 - RNA, 21 nt, Artificial Sequence
  source: /note="Description of Artificial Sequence: Synthetic oligonucleotide"
cuuucaugccucuuaaaaacu

SEQ ID NO: 189 - RNA, 21 nt, Artificial Sequence
  source: /note="Description of Artificial Sequence: Synthetic oligonucleotide"
aaaacauugguuuggcacuau

SEQ ID NO: 190 - RNA, 21 nt, Artificial Sequence
  source: /note="Description of Artificial Sequence: Synthetic oligonucleotide"
gauuaauuaccugucuuccuu

SEQ ID NO: 191 - RNA, 21 nt, Artificial Sequence
  source: /note="Description of Artificial Sequence: Synthetic oligonucleotide"
uuaccugucuuccuguuucuu

SEQ ID NO: 192 - RNA, 21 nt, Artificial Sequence
  source: /note="Description of Artificial Sequence: Synthetic oligonucleotide"
ccugucuuccuguuucucaau

SEQ ID NO: 193 - RNA, 21 nt, Artificial Sequence
  source: /note="Description of Artificial Sequence: Synthetic oligonucleotide"
ggucuguuuuuccuuucaugu

SEQ ID NO: 194 - RNA, 21 nt, Artificial Sequence
  source: /note="Description of Artificial Sequence: Synthetic oligonucleotide"
gucuguuuuuccuuucaugcu

SEQ ID NO: 195 - RNA, 21 nt, Artificial Sequence
  source: /note="Description of Artificial Sequence: Synthetic oligonucleotide"
uuauuuacacagggaagguuu

SEQ ID NO: 196 - RNA, 21 nt, Artificial Sequence
  source: /note="Description of Artificial Sequence: Synthetic oligonucleotide"
uauuuacacagggaagguuua

SEQ ID NO: 197 - RNA, 21 nt, Artificial Sequence
  source: /note="Description of Artificial Sequence: Synthetic oligonucleotide"
uuacacagggaagguuuaaga

SEQ ID NO: 198 - RNA, 21 nt, Artificial Sequence
  source: /note="Description of Artificial Sequence: Synthetic oligonucleotide"
acacagggaagguuuaagacu

SEQ ID NO: 199 - RNA, 21 nt, Artificial Sequence
  source: /note="Description of Artificial Sequence: Synthetic oligonucleotide"
gggaagguuuaagacuguuca

SEQ ID NO: 200 - RNA, 21 nt, Artificial Sequence
  source: /note="Description of Artificial Sequence: Synthetic oligonucleotide"
ggaagguuuaagacuguucaa

SEQ ID NO: 201 - RNA, 21 nt, Artificial Sequence
  source: /note="Description of Artificial Sequence: Synthetic oligonucleotide"
agguuuaagacuguucaagua

SEQ ID NO: 202 - RNA, 21 nt, Artificial Sequence
  source: /note="Description of Artificial Sequence: Synthetic oligonucleotide"
uuuaagacuguucaaguagca

SEQ ID NO: 203 - RNA, 21 nt, Artificial Sequence
  source: /note="Description of Artificial Sequence: Synthetic oligonucleotide"
uaagacuguucaaguagcauu

SEQ ID NO: 204 - RNA, 21 nt, Artificial Sequence
  source: /note="Description of Artificial Sequence: Synthetic oligonucleotide"
gacuguucaaguagcauucca

SEQ ID NO: 205 - RNA, 21 nt, Artificial Sequence
  source: /note="Description of Artificial Sequence: Synthetic oligonucleotide"
acuguucaaguagcauuccaa

SEQ ID NO: 206 - RNA, 21 nt, Artificial Sequence
  source: /note="Description of Artificial Sequence: Synthetic oligonucleotide"
cuguucaaguagcauuccaau

SEQ ID NO: 207 - RNA, 21 nt, Artificial Sequence
  source: /note="Description of Artificial Sequence: Synthetic oligonucleotide"
guucaaguagcauuccaaucu

SEQ ID NO: 208 - RNA, 21 nt, Artificial Sequence
  source: /note="Description of Artificial Sequence: Synthetic oligonucleotide"
caaguagcauuccaaucugua

SEQ ID NO: 209 - RNA, 21 nt, Artificial Sequence
  source: /note="Description of Artificial Sequence: Synthetic oligonucleotide"
uagcauuccaaucuguagcca

SEQ ID NO: 210 - RNA, 21 nt, Artificial Sequence
  source: /note="Description of Artificial Sequence: Synthetic oligonucleotide"
agcauuccaaucuguagccau

SEQ ID NO: 211 - RNA, 21 nt, Artificial Sequence
  source: /note="Description of Artificial Sequence: Synthetic oligonucleotide"
aacuuauuuacacagggaagu

SEQ ID NO: 212 - RNA, 21 nt, Artificial Sequence
  source: /note="Description of Artificial Sequence: Synthetic oligonucleotide"
uacacagggaagguuuaagau

SEQ ID NO: 213 - RNA, 21 nt, Artificial Sequence
  source: /note="Description of Artificial Sequence: Synthetic oligonucleotide"
cacagggaagguuuaagacuu

SEQ ID NO: 214 - RNA, 21 nt, Artificial Sequence
  source: /note="Description of Artificial Sequence: Synthetic oligonucleotide"
agggaagguuuaagacuguuu

SEQ ID NO: 215 - RNA, 21 nt, Artificial Sequence
  source: /note="Description of Artificial Sequence: Synthetic oligonucleotide"
gaagguuuaagacuguucaau

SEQ ID NO: 216 - RNA, 21 nt, Artificial Sequence
  source: /note="Description of Artificial Sequence: Synthetic oligonucleotide"
gguuuaagacuguucaaguau

SEQ ID NO: 217 - RNA, 21 nt, Artificial Sequence
  source: /note="Description of Artificial Sequence: Synthetic oligonucleotide"
aagacuguucaaguagcauuu

SEQ ID NO: 218 - RNA, 21 nt, Artificial Sequence
  source: /note="Description of Artificial Sequence: Synthetic oligonucleotide"
agacuguucaaguagcauucu

SEQ ID NO: 219 - RNA, 21 nt, Artificial Sequence
  source: /note="Description of Artificial Sequence: Synthetic oligonucleotide"
uguucaaguagcauuccaauu

SEQ ID NO: 220 - RNA, 21 nt, Artificial Sequence
  source: /note="Description of Artificial Sequence: Synthetic oligonucleotide"
uucaaguagcauuccaaucuu

SEQ ID NO: 221 - RNA, 21 nt, Artificial Sequence
  source: /note="Description of Artificial Sequence: Synthetic oligonucleotide"
gcagcuuuaucucaaccugga

SEQ ID NO: 222 - RNA, 21 nt, Artificial Sequence
  source: /note="Description of Artificial Sequence: Synthetic oligonucleotide"
agcauuugaaagauuucccua

SEQ ID NO: 223 - RNA, 21 nt, Artificial Sequence
  source: /note="Description of Artificial Sequence: Synthetic oligonucleotide"
ugaaagauuucccuagccucu

SEQ ID NO: 224 - RNA, 21 nt, Artificial Sequence
  source: /note="Description of Artificial Sequence: Synthetic oligonucleotide"
gaaagauuucccuagccucuu

SEQ ID NO: 225 - RNA, 21 nt, Artificial Sequence
  source: /note="Description of Artificial Sequence: Synthetic oligonucleotide"
uucccuagccucuuccuuuuu

SEQ ID NO: 226 - RNA, 21 nt, Artificial Sequence
  source: /note="Description of Artificial Sequence: Synthetic oligonucleotide"
aagaacacagaaugagugcau

SEQ ID NO: 227 - RNA, 21 nt, Artificial Sequence
  source: /note="Description of Artificial Sequence: Synthetic oligonucleotide"
gaacacagaaugagugcacau

SEQ ID NO: 228 - RNA, 21 nt, Artificial Sequence
  source: /note="Description of Artificial Sequence: Synthetic oligonucleotide"
aacacagaaugagugcacagu

SEQ ID NO: 229 - RNA, 21 nt, Artificial Sequence
  source: /note="Description of Artificial Sequence: Synthetic oligonucleotide"
cagaaugagugcacagcuaau

SEQ ID NO: 230 - RNA, 21 nt, Artificial Sequence
  source: /note="Description of Artificial Sequence: Synthetic oligonucleotide"
gaaugagugcacagcuaagau

SEQ ID NO: 231 - RNA, 21 nt, Artificial Sequence
  source: /note="Description of Artificial Sequence: Synthetic oligonucleotide"
uucagcauuugaaagauuucu

SEQ ID NO: 232 - RNA, 21 nt, Artificial Sequence
  source: /note="Description of Artificial Sequence: Synthetic oligonucleotide"
cauuugaaagauuucccuagu

SEQ ID NO: 233 - RNA, 21 nt, Artificial Sequence
  source: /note="Description of Artificial Sequence: Synthetic oligonucleotide"
auuugaaagauuucccuagcu

SEQ ID NO: 234 - RNA, 21 nt, Artificial Sequence
  source: /note="Description of Artificial Sequence: Synthetic oligonucleotide"
aaaacggugcaacucuauucu

SEQ ID NO: 235 - RNA, 21 nt, Artificial Sequence
  source: /note="Description of Artificial Sequence: Synthetic oligonucleotide"
ggugcaacucuauucuggacu

SEQ ID NO: 236 - RNA, 21 nt, Artificial Sequence
  source: /note="Description of Artificial Sequence: Synthetic oligonucleotide"
gugcaacucuauucuggacuu

SEQ ID NO: 237 - RNA, 21 nt, Artificial Sequence
  source: /note="Description of Artificial Sequence: Synthetic oligonucleotide"
ugcaacucuauucuggacuuu

SEQ ID NO: 238 - RNA, 21 nt, Artificial Sequence
  source: /note="Description of Artificial Sequence: Synthetic oligonucleotide"
gcaacucuauucuggacuuua

SEQ ID NO: 239 - RNA, 21 nt, Artificial Sequence
  source: /note="Description of Artificial Sequence: Synthetic oligonucleotide"
caacucuauucuggacuuuau

SEQ ID NO: 240 - RNA, 21 nt, Artificial Sequence
  source: /note="Description of Artificial Sequence: Synthetic oligonucleotide"
aacucuauucuggacuuuauu

SEQ ID NO: 241 - RNA, 21 nt, Artificial Sequence
  source: /note="Description of Artificial Sequence: Synthetic oligonucleotide"
auucuggacuuuauuacuuga

SEQ ID NO: 242 - RNA, 21 nt, Artificial Sequence
  source: /note="Description of Artificial Sequence: Synthetic oligonucleotide"
aguccaccaaaaguggacccu

SEQ ID NO: 243 - RNA, 21 nt, Artificial Sequence
  source: /note="Description of Artificial Sequence: Synthetic oligonucleotide"
caccaaaaguggacccucuau

SEQ ID NO: 244 - RNA, 21 nt, Artificial Sequence
  source: /note="Description of Artificial Sequence: Synthetic oligonucleotide"
accaaaaguggacccucuaua

SEQ ID NO: 245 - RNA, 21 nt, Artificial Sequence
  source: /note="Description of Artificial Sequence: Synthetic oligonucleotide"
ccaaaaguggacccucuauau

SEQ ID NO: 246 - RNA, 21 nt, Artificial Sequence
  source: /note="Description of Artificial Sequence: Synthetic oligonucleotide"
caaaaguggacccucuauauu

SEQ ID NO: 247 - RNA, 21 nt, Artificial Sequence
  source: /note="Description of Artificial Sequence: Synthetic oligonucleotide"
aaaaguggacccucuauauuu

SEQ ID NO: 248 - RNA, 21 nt, Artificial Sequence
  source: /note="Description of Artificial Sequence: Synthetic oligonucleotide"
aaacggugcaacucuauucuu

SEQ ID NO: 249 - RNA, 21 nt, Artificial Sequence
  source: /note="Description of Artificial Sequence: Synthetic oligonucleotide"
aacggugcaacucuauucugu

SEQ ID NO: 250 - RNA, 21 nt, Artificial Sequence
  source: /note="Description of Artificial Sequence: Synthetic oligonucleotide"
uauucuggacuuuauuacuuu

SEQ ID NO: 251 - RNA, 21 nt, Artificial Sequence
  source: /note="Description of Artificial Sequence: Synthetic oligonucleotide"
aaaguggacccucuauauuuc

SEQ ID NO: 252 - RNA, 21 nt, Artificial Sequence
  source: /note="Description of Artificial Sequence: Synthetic oligonucleotide"
aaguggacccucuauauuucu

SEQ ID NO: 253 - RNA, 21 nt, Artificial Sequence
  source: /note="Description of Artificial Sequence: Synthetic oligonucleotide"
auguuuagacaauuuuaggcu

SEQ ID NO: 254 - RNA, 21 nt, Artificial Sequence
  source: /note="Description of Artificial Sequence: Synthetic oligonucleotide"
guuuagacaauuuuaggcuca

SEQ ID NO: 255 - RNA, 21 nt, Artificial Sequence
  source: /note="Description of Artificial Sequence: Synthetic oligonucleotide"
uuuagacaauuuuaggcucaa

SEQ ID NO: 256 - RNA, 21 nt, Artificial Sequence
  source: /note="Description of Artificial Sequence: Synthetic oligonucleotide"
uuagacaauuuuaggcucaaa

SEQ ID NO: 257 - RNA, 21 nt, Artificial Sequence
  source: /note="Description of Artificial Sequence: Synthetic oligonucleotide"
uagacaauuuuaggcucaaaa

SEQ ID NO: 258 - RNA, 21 nt, Artificial Sequence
  source: /note="Description of Artificial Sequence: Synthetic oligonucleotide"
agacaauuuuaggcucaaaaa

SEQ ID NO: 259 - RNA, 21 nt, Artificial Sequence
  source: /note="Description of Artificial Sequence: Synthetic oligonucleotide"
gacaauuuuaggcucaaaaau

SEQ ID NO: 260 - RNA, 21 nt, Artificial Sequence
  source: /note="Description of Artificial Sequence: Synthetic oligonucleotide"
uuaggcucaaaaauuaaagcu

SEQ ID NO: 261 - RNA, 21 nt, Artificial Sequence
  source: /note="Description of Artificial Sequence: Synthetic oligonucleotide"
uaggcucaaaaauuaaagcua

SEQ ID NO: 262 - RNA, 21 nt, Artificial Sequence
  source: /note="Description of Artificial Sequence: Synthetic oligonucleotide"
aggcucaaaaauuaaagcuaa

SEQ ID NO: 263 - RNA, 21 nt, Artificial Sequence
  source: /note="Description of Artificial Sequence: Synthetic oligonucleotide"
gcucaaaaauuaaagcuaaca

SEQ ID NO: 264 - RNA, 21 nt, Artificial Sequence
  source: /note="Description of Artificial Sequence: Synthetic oligonucleotide"
ucaaaaauuaaagcuaacaca

SEQ ID NO: 265 - RNA, 21 nt, Artificial Sequence
  source: /note="Description of Artificial Sequence: Synthetic oligonucleotide"
uucauauauccuuggucccau

SEQ ID NO: 266 - RNA, 21 nt, Artificial Sequence
  source: /note="Description of Artificial Sequence: Synthetic oligonucleotide"
gauguuuagacaauuuuaggu

SEQ ID NO: 267 - RNA, 21 nt, Artificial Sequence
  source: /note="Description of Artificial Sequence: Synthetic oligonucleotide"
ggcucaaaaauuaaagcuaau

SEQ ID NO: 268 - RNA, 21 nt, Artificial Sequence
  source: /note="Description of Artificial Sequence: Synthetic oligonucleotide"
cucaaaaauuaaagcuaacau

SEQ ID NO: 269 - RNA, 21 nt, Artificial Sequence
  source: /note="Description of Artificial Sequence: Synthetic oligonucleotide"
caaaaauuaaagcuaacacau

SEQ ID NO: 270 - RNA, 21 nt, Artificial Sequence
  source: /note="Description of Artificial Sequence: Synthetic oligonucleotide"
aaauuaaagcuaacacaggaa

SEQ ID NO: 271 - RNA, 21 nt, Artificial Sequence
  source: /note="Description of Artificial Sequence: Synthetic oligonucleotide"
uaacacaggaaaaggaacugu

SEQ ID NO: 272 - RNA, 21 nt, Artificial Sequence
  source: /note="Description of Artificial Sequence: Synthetic oligonucleotide"
ggaaaaggaacuguacuggcu

SEQ ID NO: 273 - RNA, 21 nt, Artificial Sequence
  source: /note="Description of Artificial Sequence: Synthetic oligonucleotide"
aaaaggaacuguacuggcuau

SEQ ID NO: 274 - RNA, 21 nt, Artificial Sequence
  source: /note="Description of Artificial Sequence: Synthetic oligonucleotide"
ggaacuguacuggcuauuaca

SEQ ID NO: 275 - RNA, 21 nt, Artificial Sequence
  source: /note="Description of Artificial Sequence: Synthetic oligonucleotide"
caggaaaaggaacuguacugu

SEQ ID NO: 276 - RNA, 21 nt, Artificial Sequence
  source: /note="Description of Artificial Sequence: Synthetic oligonucleotide"
aggaacuguacuggcuauuau

SEQ ID NO: 277 - RNA, 21 nt, Artificial Sequence
  source: /note="Description of Artificial Sequence: Synthetic oligonucleotide"
cucccacuacaucaagacuaa

SEQ ID NO: 278 - RNA, 21 nt, Artificial Sequence
  source: /note="Description of Artificial Sequence: Synthetic oligonucleotide"
ucccacuacaucaagacuaau

SEQ ID NO: 279 - RNA, 21 nt, Artificial Sequence
  source: /note="Description of Artificial Sequence: Synthetic oligonucleotide"
ccacuacaucaagacuaaucu

SEQ ID NO: 280 - RNA, 21 nt, Artificial Sequence
  source: /note="Description of Artificial Sequence: Synthetic oligonucleotide"
cacuacaucaagacuaaucuu

SEQ ID NO: 281 - RNA, 21 nt, Artificial Sequence
  source: /note="Description of Artificial Sequence: Synthetic oligonucleotide"
cuacaucaagacuaaucuugu

SEQ ID NO: 282 - RNA, 21 nt, Artificial Sequence
  source: /note="Description of Artificial Sequence: Synthetic oligonucleotide"
uacaucaagacuaaucuuguu

SEQ ID NO: 283 - RNA, 21 nt, Artificial Sequence
  source: /note="Description of Artificial Sequence: Synthetic oligonucleotide"
acaucaagacuaaucuuguuu

SEQ ID NO: 284 - RNA, 21 nt, Artificial Sequence
  source: /note="Description of Artificial Sequence: Synthetic oligonucleotide"
guguuuuucacauguauuaua

SEQ ID NO: 285 - RNA, 21 nt, Artificial Sequence
  source: /note="Description of Artificial Sequence: Synthetic oligonucleotide"
ucacauguauuauagaaugcu

SEQ ID NO: 286 - RNA, 21 nt, Artificial Sequence
  source: /note="Description of Artificial Sequence: Synthetic oligonucleotide"
cacauguauuauagaaugcuu

SEQ ID NO: 287 - RNA, 21 nt, Artificial Sequence
  source: /note="Description of Artificial Sequence: Synthetic oligonucleotide"
guauuauagaaugcuuuugca

SEQ ID NO: 288 - RNA, 21 nt, Artificial Sequence
  source: /note="Description of Artificial Sequence: Synthetic oligonucleotide"
uauagaaugcuuuugcaugga

SEQ ID NO: 289 - RNA, 21 nt, Artificial Sequence
  source: /note="Description of Artificial Sequence: Synthetic oligonucleotide"
agaaugcuuuugcauggacua

SEQ ID NO: 290 - RNA, 21 nt, Artificial Sequence
  source: /note="Description of Artificial Sequence: Synthetic oligonucleotide"
gaaugcuuuugcauggacuau

SEQ ID NO: 291 - RNA, 21 nt, Artificial Sequence
  source: /note="Description of Artificial Sequence: Synthetic oligonucleotide"
ugcuuuugcauggacuauccu

SEQ ID NO: 292 - RNA, 21 nt, Artificial Sequence
  source: /note="Description of Artificial Sequence: Synthetic oligonucleotide"
cuuuugcauggacuauccucu

SEQ ID NO: 293 - RNA, 21 nt, Artificial Sequence
  source: /note="Description of Artificial Sequence: Synthetic oligonucleotide"
uugcauggacuauccucuugu

SEQ ID NO: 294 - RNA, 21 nt, Artificial Sequence
  source: /note="Description of Artificial Sequence: Synthetic oligonucleotide"
ugcauggacuauccucuuguu

SEQ ID NO: 295 - RNA, 21 nt, Artificial Sequence
  source: /note="Description of Artificial Sequence: Synthetic oligonucleotide"
gcauggacuauccucuuguuu

SEQ ID NO: 296 - RNA, 21 nt, Artificial Sequence
  source: /note="Description of Artificial Sequence: Synthetic oligonucleotide"
ggacuauccucuuguuuuuau

SEQ ID NO: 297 - RNA, 21 nt, Artificial Sequence
  source: /note="Description of Artificial Sequence: Synthetic oligonucleotide"
gacuauccucuuguuuuuauu

SEQ ID NO: 298 - RNA, 21 nt, Artificial Sequence
  source: /note="Description of Artificial Sequence: Synthetic oligonucleotide"
cuauccucuuguuuuuauuaa

SEQ ID NO: 299 - RNA, 21 nt, Artificial Sequence
  source: /note="Description of Artificial Sequence: Synthetic oligonucleotide"
cccacuacaucaagacuaauu

SEQ ID NO: 300 - RNA, 21 nt, Artificial Sequence
  source: /note="Description of Artificial Sequence: Synthetic oligonucleotide"
acuacaucaagacuaaucuuu

SEQ ID NO: 301 - RNA, 21 nt, Artificial Sequence
  source: /note="Description of Artificial Sequence: Synthetic oligonucleotide"
augcuuuugcauggacuaucu

SEQ ID NO: 302 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagucctagggaggagguacugu

SEQ ID NO: 303 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggugatcagaagcagaaggauu

SEQ ID NO: 304 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaagtaggaguagaugauggu

SEQ ID NO: 305 - RNA, 23 nt, Artificial Sequence
  source: /note="Description of Artificial Sequence: Synthetic oligonucleotide"
acgacuccaaguaggaguagaug

SEQ ID NO: 306 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgactccaaguaggaguagau

SEQ ID NO: 307 - RNA, 23 nt, Artificial Sequence
  source: /note="Description of Artificial Sequence: Synthetic oligonucleotide"
auaguccuagggaggagguacug

SEQ ID NO: 308 - RNA, 23 nt, Artificial Sequence
  source: /note="Description of Artificial Sequence: Synthetic oligonucleotide"
auucugguucaguccuuguguag

SEQ ID NO: 309 - RNA, 23 nt, Artificial Sequence
  source: /note="Description of Artificial Sequence: Synthetic oligonucleotide"
aaaguaggaguagaugaugguga

SEQ ID NO: 310 - RNA, 23 nt, Artificial Sequence
  source: /note="Description of Artificial Sequence: Synthetic oligonucleotide"
acaaguaggaguagaugauggug

SEQ ID NO: 311 - RNA, 23 nt, Artificial Sequence
  source: /note="Description of Artificial Sequence: Synthetic oligonucleotide"
auccaaguaggaguagaugaugg

SEQ ID NO: 312 - RNA, 23 nt, Artificial Sequence
  source: /note="Description of Artificial Sequence: Synthetic oligonucleotide"
aacuccaaguaggaguagaugau

SEQ ID NO: 313 - RNA, 23 nt, Artificial Sequence
  source: /note="Description of Artificial Sequence: Synthetic oligonucleotide"
aaacgacuccaaguaggaguaga

SEQ ID NO: 314 - RNA, 23 nt, Artificial Sequence
  source: /note="Description of Artificial Sequence: Synthetic oligonucleotide"
acaacgacuccaaguaggaguag

SEQ ID NO: 315 - RNA, 23 nt, Artificial Sequence
  source: /note="Description of Artificial Sequence: Synthetic oligonucleotide"
accaacgacuccaaguaggagua

SEQ ID NO: 316 - RNA, 23 nt, Artificial Sequence
  source: /note="Description of Artificial Sequence: Synthetic oligonucleotide"
aaccaacgacuccaaguaggagu

SEQ ID NO: 317 - RNA, 23 nt, Artificial Sequence
  source: /note="Description of Artificial Sequence: Synthetic oligonucleotide"
uuucggcacucagcugcaguuuc

SEQ ID NO: 318 - RNA, 23 nt, Artificial Sequence
  source: /note="Description of Artificial Sequence: Synthetic oligonucleotide"
uuuucggcacucagcugcaguuu

SEQ ID NO: 319 - RNA, 23 nt, Artificial Sequence
  source: /note="Description of Artificial Sequence: Synthetic oligonucleotide"
aguuuucggcacucagcugcagu

SEQ ID NO: 320 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguuutcggcacucagcugcag

SEQ ID NO: 321 - RNA, 23 nt, Artificial Sequence
  source: /note="Description of Artificial Sequence: Synthetic oligonucleotide"
ugacgccuaguuuucggcacuca

SEQ ID NO: 322 - RNA, 23 nt, Artificial Sequence
  source: /note="Description of Artificial Sequence: Synthetic oligonucleotide"
agugacgccuaguuuucggcacu

SEQ ID NO: 323 - RNA, 23 nt, Artificial Sequence
  source: /note="Description of Artificial Sequence: Synthetic oligonucleotide"
acgcuuauuaauaucccacagaa

SEQ ID NO: 324 - RNA, 23 nt, Artificial Sequence
  source: /note="Description of Artificial Sequence: Synthetic oligonucleotide"
auuuucggcacucagcugcaguu

SEQ ID NO: 325 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaguutucggcacucagcugca

SEQ ID NO: 326 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuagutuucggcacucagcugc

SEQ ID NO: 327 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accuagtuuucggcacucagcug

SEQ ID NO: 328 - RNA, 23 nt, Artificial Sequence
  source: /note="Description of Artificial Sequence: Synthetic oligonucleotide"
agccuaguuuucggcacucagcu

SEQ ID NO: 329 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgcctaguuuucggcacucag

SEQ ID NO: 330 - RNA, 23 nt, Artificial Sequence
  source: /note="Description of Artificial Sequence: Synthetic oligonucleotide"
augacgccuaguuuucggcacuc

SEQ ID NO: 331 - RNA, 23 nt, Artificial Sequence
  source: /note="Description of Artificial Sequence: Synthetic oligonucleotide"
aagugacgccuaguuuucggcac

SEQ ID NO: 332 - RNA, 23 nt, Artificial Sequence
  source: /note="Description of Artificial Sequence: Synthetic oligonucleotide"
acagugacgccuaguuuucggca

SEQ ID NO: 333 - RNA, 23 nt, Artificial Sequence
  source: /note="Description of Artificial Sequence: Synthetic oligonucleotide"
acaugcgcagugacgccuaguuu

SEQ ID NO: 334 - RNA, 23 nt, Artificial Sequence
  source: /note="Description of Artificial Sequence: Synthetic oligonucleotide"
ugauuuagagagcgauagaucuc

SEQ ID NO: 335 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accugatuuagagagcgauagau

SEQ ID NO: 336 - RNA, 23 nt, Artificial Sequence
  source: /note="Description of Artificial Sequence: Synthetic oligonucleotide"
ucaccugauuuagagagcgauag

SEQ ID NO: 337 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacctgauuuagagagcgaua

SEQ ID NO: 338 - RNA, 23 nt, Artificial Sequence
  source: /note="Description of Artificial Sequence: Synthetic oligonucleotide"
uuucuucaccugauuuagagagc

SEQ ID NO: 339 - RNA, 23 nt, Artificial Sequence
  source: /note="Description of Artificial Sequence: Synthetic oligonucleotide"
ugucccagcauuauucaccacga

SEQ ID NO: 340 - RNA, 23 nt, Artificial Sequence
  source: /note="Description of Artificial Sequence: Synthetic oligonucleotide"
uauacugucccagcauuauucac

SEQ ID NO: 341 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auauactgucccagcauuauuca

SEQ ID NO: 342 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucggctggauauacugucccag

SEQ ID NO: 343 - RNA, 23 nt, Artificial Sequence
  source: /note="Description of Artificial Sequence: Synthetic oligonucleotide"
agaucggcuggauauacuguccc

SEQ ID NO: 344 - RNA, 23 nt, Artificial Sequence
  source: /note="Description of Artificial Sequence: Synthetic oligonucleotide"
aagaucggcuggauauacugucc

SEQ ID NO: 345 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaagatcggcuggauauacugu

SEQ ID NO: 346 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augauutagagagcgauagaucu

SEQ ID NO: 347 - RNA, 23 nt, Artificial Sequence
  source: /note="Description of Artificial Sequence: Synthetic oligonucleotide"
aaccugauuuagagagcgauaga

SEQ ID NO: 348 - RNA, 23 nt, Artificial Sequence
  source: /note="Description of Artificial Sequence: Synthetic oligonucleotide"
auucaccugauuuagagagcgau

SEQ ID NO: 349 - RNA, 23 nt, Artificial Sequence
  source: /note="Description of Artificial Sequence: Synthetic oligonucleotide"
aucccagcauuauucaccacgau

SEQ ID NO: 350 - RNA, 23 nt, Artificial Sequence
  source: /note="Description of Artificial Sequence: Synthetic oligonucleotide"
augucccagcauuauucaccacg

SEQ ID NO: 351 - RNA, 23 nt, Artificial Sequence
  source: /note="Description of Artificial Sequence: Synthetic oligonucleotide"
auggauauacugucccagcauua

SEQ ID NO: 352 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuggatauacugucccagcauu

SEQ ID NO: 353 - RNA, 23 nt, Artificial Sequence
  source: /note="Description of Artificial Sequence: Synthetic oligonucleotide"
agcuggauauacugucccagcau

SEQ ID NO: 354 - RNA, 23 nt, Artificial Sequence
  source: /note="Description of Artificial Sequence: Synthetic oligonucleotide"
aggcuggauauacugucccagca

SEQ ID NO: 355 - RNA, 23 nt, Artificial Sequence
  source: /note="Description of Artificial Sequence: Synthetic oligonucleotide"
aaucggcuggauauacuguccca

SEQ ID NO: 356 - RNA, 23 nt, Artificial Sequence
  source: /note="Description of Artificial Sequence: Synthetic oligonucleotide"
aaagaucggcuggauauacuguc

SEQ ID NO: 357 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguaatcucuucauccuuggug

SEQ ID NO: 358 - RNA, 23 nt, Artificial Sequence
  source: /note="Description of Artificial Sequence: Synthetic oligonucleotide"
uugguaaucucuucauccuuggu

SEQ ID NO: 359 - RNA, 23 nt, Artificial Sequence
  source: /note="Description of Artificial Sequence: Synthetic oligonucleotide"
uccuaggauguugaccucaaaug

SEQ ID NO: 360 - RNA, 23 nt, Artificial Sequence
  source: /note="Description of Artificial Sequence: Synthetic oligonucleotide"
uguccuaggauguugaccucaaa

SEQ ID NO: 361 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augucctaggauguugaccucaa

SEQ ID NO: 362 - RNA, 23 nt, Artificial Sequence
  source: /note="Description of Artificial Sequence: Synthetic oligonucleotide"
aaauguccuaggauguugaccuc

SEQ ID NO: 363 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaugtccuaggauguugaccu

SEQ ID NO: 364 - RNA, 23 nt, Artificial Sequence
  source: /note="Description of Artificial Sequence: Synthetic oligonucleotide"
uccaaaaauguccuaggauguug

SEQ ID NO: 365 - RNA, 23 nt, Artificial Sequence
  source: /note="Description of Artificial Sequence: Synthetic oligonucleotide"
auccaaaaauguccuaggauguu

SEQ ID NO: 366 - RNA, 23 nt, Artificial Sequence
  source: /note="Description of Artificial Sequence: Synthetic oligonucleotide"
ugauccaaaaauguccuaggaug

SEQ ID NO: 367 - RNA, 23 nt, Artificial Sequence
  source: /note="Description of Artificial Sequence: Synthetic oligonucleotide"
uuugugauccaaaaauguccuag

SEQ ID NO: 368 - RNA, 23 nt, Artificial Sequence
  source: /note="Description of Artificial Sequence: Synthetic oligonucleotide"
uuuugugauccaaaaauguccua

SEQ ID NO: 369 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugcutuugugauccaaaaaug

SEQ ID NO: 370 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaagtgcuuuugugauccaaa

SEQ ID NO: 371 - RNA, 23 nt, Artificial Sequence
  source: /note="Description of Artificial Sequence: Synthetic oligonucleotide"
ucgauggaagaagugcuuuugug

SEQ ID NO: 372 - RNA, 23 nt, Artificial Sequence
  source: /note="Description of Artificial Sequence: Synthetic oligonucleotide"
aucgauggaagaagugcuuuugu

SEQ ID NO: 373 - RNA, 23 nt, Artificial Sequence
  source: /note="Description of Artificial Sequence: Synthetic oligonucleotide"
ucaucgauggaagaagugcuuuu

SEQ ID NO: 374 - RNA, 23 nt, Artificial Sequence
  source: /note="Description of Artificial Sequence: Synthetic oligonucleotide"
aucaucgauggaagaagugcuuu

SEQ ID NO: 375 - RNA, 23 nt, Artificial Sequence
  source: /note="Description of Artificial Sequence: Synthetic oligonucleotide"
auguggccaugauuucucuccau

SEQ ID NO: 376 - RNA, 23 nt, Artificial Sequence
  source: /note="Description of Artificial Sequence: Synthetic oligonucleotide"
aguaaucucuucauccuuggugc

SEQ ID NO: 377 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaugutgaccucaaaugucuug

SEQ ID NO: 378 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaggatguugaccucaaauguc

SEQ ID NO: 379 - RNA, 23 nt, Artificial Sequence
  source: /note="Description of Artificial Sequence: Synthetic oligonucleotide"
acuaggauguugaccucaaaugu

SEQ ID NO: 380 - RNA, 23 nt, Artificial Sequence
  source: /note="Description of Artificial Sequence: Synthetic oligonucleotide"
auccuaggauguugaccucaaau

SEQ ID NO: 381 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaaaatguccuaggauguugac

SEQ ID NO: 382 - RNA, 23 nt, Artificial Sequence
  source: /note="Description of Artificial Sequence: Synthetic oligonucleotide"
acaaaaauguccuaggauguuga

SEQ ID NO: 383 - RNA, 23 nt, Artificial Sequence
  source: /note="Description of Artificial Sequence: Synthetic oligonucleotide"
aauccaaaaauguccuaggaugu

SEQ ID NO: 384 - RNA, 23 nt, Artificial Sequence
  source: /note="Description of Artificial Sequence: Synthetic oligonucleotide"
augauccaaaaauguccuaggau

SEQ ID NO: 385 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuugtgauccaaaaauguccu

SEQ ID NO: 386 - RNA, 23 nt, Artificial Sequence
  source: /note="Description of Artificial Sequence: Synthetic oligonucleotide"
aaagaagugcuuuugugauccaa

SEQ ID NO: 387 - RNA, 23 nt, Artificial Sequence
  source: /note="Description of Artificial Sequence: Synthetic oligonucleotide"
aauggaagaagugcuuuugugau

SEQ ID NO: 388 - RNA, 23 nt, Artificial Sequence
  source: /note="Description of Artificial Sequence: Synthetic oligonucleotide"
agauggaagaagugcuuuuguga

SEQ ID NO: 389 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucgatggaagaagugcuuuug

SEQ ID NO: 390 - RNA, 23 nt, Artificial Sequence
  source: /note="Description of Artificial Sequence: Synthetic oligonucleotide"
aaucaucgauggaagaagugcuu

SEQ ID NO: 391 - RNA, 23 nt, Artificial Sequence
  source: /note="Description of Artificial Sequence: Synthetic oligonucleotide"
aacgauguggccaugauuucucu

SEQ ID NO: 392 - RNA, 23 nt, Artificial Sequence
  source: /note="Description of Artificial Sequence: Synthetic oligonucleotide"
augacgauguggccaugauuucu

SEQ ID NO: 393 - RNA, 23 nt, Artificial Sequence
  source: /note="Description of Artificial Sequence: Synthetic oligonucleotide"
aauaugggaugagguaaggaauc

SEQ ID NO: 394 - RNA, 23 nt, Artificial Sequence
  source: /note="Description of Artificial Sequence: Synthetic oligonucleotide"
uggaacaauaugggaugagguaa

SEQ ID NO: 395 - RNA, 23 nt, Artificial Sequence
  source: /note="Description of Artificial Sequence: Synthetic oligonucleotide"
ugcuggaacaauaugggaugagg

SEQ ID NO: 396 - RNA, 23 nt, Artificial Sequence
  source: /note="Description of Artificial Sequence: Synthetic oligonucleotide"
uugcuggaacaauaugggaugag

SEQ ID NO: 397 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuugctggaacaauaugggaug

SEQ ID NO: 398 - RNA, 23 nt, Artificial Sequence
  source: /note="Description of Artificial Sequence: Synthetic oligonucleotide"
aauuugcuggaacaauaugggau

SEQ ID NO: 399 - RNA, 23 nt, Artificial Sequence
  source: /note="Description of Artificial Sequence: Synthetic oligonucleotide"
agaccucugugaaagccaacagc

SEQ ID NO: 400 - RNA, 23 nt, Artificial Sequence
  source: /note="Description of Artificial Sequence: Synthetic oligonucleotide"
ugucagaccucugugaaagccaa

SEQ ID NO: 401 - RNA, 23 nt, Artificial Sequence
  source: /note="Description of Artificial Sequence: Synthetic oligonucleotide"
augucagaccucugugaaagcca

SEQ ID NO: 402 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucugatgucagaccucugugaa

SEQ ID NO: 403 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaagutcugaugucagaccucu

SEQ ID NO: 404 - RNA, 23 nt, Artificial Sequence
  source: /note="Description of Artificial Sequence: Synthetic oligonucleotide"
aaauaugggaugagguaaggaau

SEQ ID NO: 405 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augaugtcagaccucugugaaag

SEQ ID NO: 406 - RNA, 23 nt, Artificial Sequence
  source: /note="Description of Artificial Sequence: Synthetic oligonucleotide"
uuugauaccaguuuuucccaagg

SEQ ID NO: 407 - RNA, 23 nt, Artificial Sequence
  source: /note="Description of Artificial Sequence: Synthetic oligonucleotide"
acaugagguuuugauaccaguuu

SEQ ID NO: 408 - RNA, 23 nt, Artificial Sequence
  source: /note="Description of Artificial Sequence: Synthetic oligonucleotide"
agacaugagguuuugauaccagu

SEQ ID NO: 409 - RNA, 23 nt, Artificial Sequence
  source: /note="Description of Artificial Sequence: Synthetic oligonucleotide"
auucacaaaaacugggcagagac

SEQ ID NO: 410 - RNA, 23 nt, Artificial Sequence
  source: /note="Description of Artificial Sequence: Synthetic oligonucleotide"
ugaacccaguauucacaaaaacu

SEQ ID NO: 411 - RNA, 23 nt, Artificial Sequence
  source: /note="Description of Artificial Sequence: Synthetic oligonucleotide"
uggugaacccaguauucacaaaa

SEQ ID NO: 412 - RNA, 23 nt, Artificial Sequence
  source: /note="Description of Artificial Sequence: Synthetic oligonucleotide"
uuggugaacccaguauucacaaa

SEQ ID NO: 413 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuuggtgaacccaguauucaca

SEQ ID NO: 414 - RNA, 23 nt, Artificial Sequence
  source: /note="Description of Artificial Sequence: Synthetic oligonucleotide"
uuuuuggugaacccaguauucac

SEQ ID NO: 415 - RNA, 23 nt, Artificial Sequence
  source: /note="Description of Artificial Sequence: Synthetic oligonucleotide"
auuuuuggugaacccaguauuca

SEQ ID NO: 416 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucutgugcuuggauuuuugg

SEQ ID NO: 417 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaauctugugcuuggauuuuug

SEQ ID NO: 418 - RNA, 23 nt, Artificial Sequence
  source: /note="Description of Artificial Sequence: Synthetic oligonucleotide"
uacaggccauaaucuugugcuug

SEQ ID NO: 419 - RNA, 23 nt, Artificial Sequence
  source: /note="Description of Artificial Sequence: Synthetic oligonucleotide"
auacaggccauaaucuugugcuu

SEQ ID NO: 420 - RNA, 23 nt, Artificial Sequence
  source: /note="Description of Artificial Sequence: Synthetic oligonucleotide"
aauacaggccauaaucuugugcu

SEQ ID NO: 421 - RNA, 23 nt, Artificial Sequence
  source: /note="Description of Artificial Sequence: Synthetic oligonucleotide"
uccaauacaggccauaaucuugu

SEQ ID NO: 422 - RNA, 23 nt, Artificial Sequence
  source: /note="Description of Artificial Sequence: Synthetic oligonucleotide"
ucuccaauacaggccauaaucuu

SEQ ID NO: 423 - RNA, 23 nt, Artificial Sequence
  source: /note="Description of Artificial Sequence: Synthetic oligonucleotide"
ugucuccaauacaggccauaauc

SEQ ID NO: 424 - RNA, 23 nt, Artificial Sequence
  source: /note="Description of Artificial Sequence: Synthetic oligonucleotide"
aucugucuccaauacaggccaua

SEQ ID NO: 425 - RNA, 23 nt, Artificial Sequence
  source: /note="Description of Artificial Sequence: Synthetic oligonucleotide"
ucaucugucuccaauacaggcca

SEQ ID NO: 426 - RNA, 23 nt, Artificial Sequence
  source: /note="Description of Artificial Sequence: Synthetic oligonucleotide"
aacaugagguuuugauaccaguu

SEQ ID NO: 427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacatgagguuuugauaccag

SEQ ID NO: 428 - RNA, 23 nt, Artificial Sequence
  source: /note="Description of Artificial Sequence: Synthetic oligonucleotide"
agcagagacaugagguuuugaua

SEQ ID NO: 429 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaguatucacaaaaacugggca

SEQ ID NO: 430 - RNA, 23 nt, Artificial Sequence
  source: /note="Description of Artificial Sequence: Synthetic oligonucleotide"
augaacccaguauucacaaaaac

SEQ ID NO: 431 - RNA, 23 nt, Artificial Sequence
  source: /note="Description of Artificial Sequence: Synthetic oligonucleotide"
agugaacccaguauucacaaaaa

SEQ ID NO: 432 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuuutggugaacccaguauuc

SEQ ID NO: 433 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauuutuggugaacccaguauu

SEQ ID NO: 434 - RNA, 23 nt, Artificial Sequence
  source: /note="Description of Artificial Sequence: Synthetic oligonucleotide"
auugugcuuggauuuuuggugaa

SEQ ID NO: 435 - RNA, 23 nt, Artificial Sequence
  source: /note="Description of Artificial Sequence: Synthetic oligonucleotide"
aauaaucuugugcuuggauuuuu

SEQ ID NO: 436 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaatcuugugcuuggauuuu

SEQ ID NO: 437 - RNA, 23 nt, Artificial Sequence
  source: /note="Description of Artificial Sequence: Synthetic oligonucleotide"
accauaaucuugugcuuggauuu

SEQ ID NO: 438 - RNA, 23 nt, Artificial Sequence
  source: /note="Description of Artificial Sequence: Synthetic oligonucleotide"
agccauaaucuugugcuuggauu

SEQ ID NO: 439 - RNA, 23 nt, Artificial Sequence
  source: /note="Description of Artificial Sequence: Synthetic oligonucleotide"
aaauacaggccauaaucuugugc

SEQ ID NO: 440 - RNA, 23 nt, Artificial Sequence
  source: /note="Description of Artificial Sequence: Synthetic oligonucleotide"
acaauacaggccauaaucuugug

SEQ ID NO: 441 - RNA, 23 nt, Artificial Sequence
  source: /note="Description of Artificial Sequence: Synthetic oligonucleotide"
aucuccaauacaggccauaaucu

SEQ ID NO: 442 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucugtcuccaauacaggccau

SEQ ID NO: 443 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccauctaucagacuucuuacga

SEQ ID NO: 444 - RNA, 23 nt, Artificial Sequence
  source: /note="Description of Artificial Sequence: Synthetic oligonucleotide"
uuccaucuaucagacuucuuacg

SEQ ID NO: 445 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuccatcuaucagacuucuuac

SEQ ID NO: 446 - RNA, 23 nt, Artificial Sequence
  source: /note="Description of Artificial Sequence: Synthetic oligonucleotide"
uauuccaucuaucagacuucuua

SEQ ID NO: 447 - RNA, 23 nt, Artificial Sequence
  source: /note="Description of Artificial Sequence: Synthetic oligonucleotide"
aguauuccaucuaucagacuucu

SEQ ID NO: 448 - RNA, 23 nt, Artificial Sequence
  source: /note="Description of Artificial Sequence: Synthetic oligonucleotide"
uuauugguaaguauuccaucuau

SEQ ID NO: 449 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuuautgguaaguauuccaucu

SEQ ID NO: 450 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucuuatugguaaguauuccauc

SEQ ID NO: 451 - RNA, 23 nt, Artificial Sequence
  source: /note="Description of Artificial Sequence: Synthetic oligonucleotide"
uuucuuauugguaaguauuccau

SEQ ID NO: 452 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucutauugguaaguauucca

SEQ ID NO: 453 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuuctuauugguaaguauucc

SEQ ID NO: 454 - RNA, 23 nt, Artificial Sequence
  source: /note="Description of Artificial Sequence: Synthetic oligonucleotide"
ugaggcgcguucaggaagaaacu

SEQ ID NO: 455 - RNA, 23 nt, Artificial Sequence
  source: /note="Description of Artificial Sequence: Synthetic oligonucleotide"
uucugcauacgauuuaaaaucgc

SEQ ID NO: 456 - RNA, 23 nt, Artificial Sequence
  source: /note="Description of Artificial Sequence: Synthetic oligonucleotide"
uauucugcauacgauuuaaaauc

SEQ ID NO: 457 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaauatucugcauacgauuuaa

SEQ ID NO: 458 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugaatauucugcauacgauuu

SEQ ID NO: 459 - RNA, 23 nt, Artificial Sequence
  source: /note="Description of Artificial Sequence: Synthetic oligonucleotide"
aauugaauauucugcauacgauu

SEQ ID NO: 460 - RNA, 23 nt, Artificial Sequence
  source: /note="Description of Artificial Sequence: Synthetic oligonucleotide"
aaauugaauauucugcauacgau

SEQ ID NO: 461 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucaaatugaauauucugcauac

SEQ ID NO: 462 - RNA, 23 nt, Artificial Sequence
  source: /note="Description of Artificial Sequence: Synthetic oligonucleotide"
auauuccaucuaucagacuucuu

SEQ ID NO: 463 - RNA, 23 nt, Artificial Sequence
  source: /note="Description of Artificial Sequence: Synthetic oligonucleotide"
auaaguauuccaucuaucagacu

SEQ ID NO: 464 - RNA, 23 nt, Artificial Sequence
  source: /note="Description of Artificial Sequence: Synthetic oligonucleotide"
auuauugguaaguauuccaucua

SEQ ID NO: 465 - RNA, 23 nt, Artificial Sequence
  source: /note="Description of Artificial Sequence: Synthetic oligonucleotide"
aguucaggaagaaacuucuguag

SEQ ID NO: 466 - RNA, 23 nt, Artificial Sequence
  source: /note="Description of Artificial Sequence: Synthetic oligonucleotide"
agcguucaggaagaaacuucugu

SEQ ID NO: 467 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcgcgtucaggaagaaacuucu

SEQ ID NO: 468 - RNA, 23 nt, Artificial Sequence
  source: /note="Description of Artificial Sequence: Synthetic oligonucleotide"
aaggcgcguucaggaagaaacuu

SEQ ID NO: 469 - RNA, 23 nt, Artificial Sequence
  source: /note="Description of Artificial Sequence: Synthetic oligonucleotide"
acugaggcgcguucaggaagaaa

SEQ ID NO: 470 - RNA, 23 nt, Artificial Sequence
  source: /note="Description of Artificial Sequence: Synthetic oligonucleotide"
acuucaaauugaauauucugcau

SEQ ID NO: 471 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacugctucaaauugaauauucu

SEQ ID NO: 472 - RNA, 23 nt, Artificial Sequence
  source: /note="Description of Artificial Sequence: Synthetic oligonucleotide"
accacugcuucaaauugaauauu

SEQ ID NO: 473 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautaucaugcauacaucuc

SEQ ID NO: 474 - RNA, 23 nt, Artificial Sequence
  source: /note="Description of Artificial Sequence: Synthetic oligonucleotide"
aaauaaagcuuugcagcauugau

SEQ ID NO: 475 - RNA, 23 nt, Artificial Sequence
  source: /note="Description of Artificial Sequence: Synthetic oligonucleotide"
aaaaaugugaaauaaagcuuugc

SEQ ID NO: 476 - RNA, 23 nt, Artificial Sequence
  source: /note="Description of Artificial Sequence: Synthetic oligonucleotide"
agccaaccacugcuucaaauuga

SEQ ID NO: 477 - RNA, 23 nt, Artificial Sequence
  source: /note="Description of Artificial Sequence: Synthetic oligonucleotide"
gaaauaaagcuuugcagcauuga

SEQ ID NO: 478 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augaaataaagcuuugcagcauu

SEQ ID NO: 479 - RNA, 23 nt, Artificial Sequence
  source: /note="Description of Artificial Sequence: Synthetic oligonucleotide"
uagugccaaaccaauguuuuuaa

SEQ ID NO: 480 - RNA, 23 nt, Artificial Sequence
  source: /note="Description of Artificial Sequence: Synthetic oligonucleotide"
aggaagacagguaauuaaucuug

SEQ ID NO: 481 - RNA, 23 nt, Artificial Sequence
  source: /note="Description of Artificial Sequence: Synthetic oligonucleotide"
acaggaagacagguaauuaaucu

SEQ ID NO: 482 - RNA, 23 nt, Artificial Sequence
  source: /note="Description of Artificial Sequence: Synthetic oligonucleotide"
aaacaggaagacagguaauuaau

SEQ ID NO: 483 - RNA, 23 nt, Artificial Sequence
  source: /note="Description of Artificial Sequence: Synthetic oligonucleotide"
ugagaaacaggaagacagguaau

SEQ ID NO: 484 - RNA, 23 nt, Artificial Sequence
  source: /note="Description of Artificial Sequence: Synthetic oligonucleotide"
uugagaaacaggaagacagguaa

SEQ ID NO: 485 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucutgagaaacaggaagaca

SEQ ID NO: 486 - RNA, 23 nt, Artificial Sequence
  source: /note="Description of Artificial Sequence: Synthetic oligonucleotide"
uuaagaggcaugaaaggaaaaac

SEQ ID NO: 487 - RNA, 23 nt, Artificial Sequence
  source: /note="Description of Artificial Sequence: Synthetic oligonucleotide"
uuuuuaagaggcaugaaaggaaa

SEQ ID NO: 488 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguuuutaagaggcaugaaagga

SEQ ID NO: 489 - RNA, 23 nt, Artificial Sequence
  source: /note="Description of Artificial Sequence: Synthetic oligonucleotide"
auagugccaaaccaauguuuuua

SEQ ID NO: 490 - RNA, 23 nt, Artificial Sequence
  source: /note="Description of Artificial Sequence: Synthetic oligonucleotide"
aaggaagacagguaauuaaucuu

SEQ ID NO: 491 - RNA, 23 nt, Artificial Sequence
  source: /note="Description of Artificial Sequence: Synthetic oligonucleotide"
aagaaacaggaagacagguaauu

SEQ ID NO: 492 - RNA, 23 nt, Artificial Sequence
  source: /note="Description of Artificial Sequence: Synthetic oligonucleotide"
auugagaaacaggaagacaggua

SEQ ID NO: 493 - RNA, 23 nt, Artificial Sequence
  source: /note="Description of Artificial Sequence: Synthetic oligonucleotide"
acaugaaaggaaaaacagaccua

SEQ ID NO: 494 - RNA, 23 nt, Artificial Sequence
  source: /note="Description of Artificial Sequence: Synthetic oligonucleotide"
agcaugaaaggaaaaacagaccu

SEQ ID NO: 495 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaccutcccuguguaaauaagu

SEQ ID NO: 496 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacctucccuguguaaauaag

SEQ ID NO: 497 - RNA, 23 nt, Artificial Sequence
  source: /note="Description of Artificial Sequence: Synthetic oligonucleotide"
ucuuaaaccuucccuguguaaau

SEQ ID NO: 498 - RNA, 23 nt, Artificial Sequence
  source: /note="Description of Artificial Sequence: Synthetic oligonucleotide"
agucuuaaaccuucccuguguaa

SEQ ID NO: 499 - RNA, 23 nt, Artificial Sequence
  source: /note="Description of Artificial Sequence: Synthetic oligonucleotide"
ugaacagucuuaaaccuucccug

SEQ ID NO: 500 - RNA, 23 nt, Artificial Sequence
  source: /note="Description of Artificial Sequence: Synthetic oligonucleotide"
uugaacagucuuaaaccuucccu

SEQ ID NO: 501 - RNA, 23 nt, Artificial Sequence
  source: /note="Description of Artificial Sequence: Synthetic oligonucleotide"
uacuugaacagucuuaaaccuuc

SEQ ID NO: 502 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuactugaacagucuuaaacc

SEQ ID NO: 503 - RNA, 23 nt, Artificial Sequence
  source: /note="Description of Artificial Sequence: Synthetic oligonucleotide"
aaugcuacuugaacagucuuaaa

SEQ ID NO: 504 - RNA, 23 nt, Artificial Sequence
  source: /note="Description of Artificial Sequence: Synthetic oligonucleotide"
uggaaugcuacuugaacagucuu

SEQ ID NO: 505 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuggaatgcuacuugaacagucu

SEQ ID NO: 506 - RNA, 23 nt, Artificial Sequence
  source: /note="Description of Artificial Sequence: Synthetic oligonucleotide"
auuggaaugcuacuugaacaguc

SEQ ID NO: 507 - RNA, 23 nt, Artificial Sequence
  source: /note="Description of Artificial Sequence: Synthetic oligonucleotide"
agauuggaaugcuacuugaacag

SEQ ID NO: 508 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacagatuggaaugcuacuugaa

SEQ ID NO: 509 - RNA, 23 nt, Artificial Sequence
  source: /note="Description of Artificial Sequence: Synthetic oligonucleotide"
uggcuacagauuggaaugcuacu

SEQ ID NO: 510 - RNA, 23 nt, Artificial Sequence
  source: /note="Description of Artificial Sequence: Synthetic oligonucleotide"
auggcuacagauuggaaugcuac

SEQ ID NO: 511 - RNA, 23 nt, Artificial Sequence
  source: /note="Description of Artificial Sequence: Synthetic oligonucleotide"
acuucccuguguaaauaaguucu

SEQ ID NO: 512 - RNA, 23 nt, Artificial Sequence
  source: /note="Description of Artificial Sequence: Synthetic oligonucleotide"
aucuuaaaccuucccuguguaaa

SEQ ID NO: 513 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagucutaaaccuucccugugua

SEQ ID NO: 514 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacagtcuuaaaccuucccugu

SEQ ID NO: 515 - RNA, 23 nt, Artificial Sequence
  source: /note="Description of Artificial Sequence: Synthetic oligonucleotide"
auugaacagucuuaaaccuuccc

SEQ ID NO: 516 - RNA, 23 nt, Artificial Sequence
  source: /note="Description of Artificial Sequence: Synthetic oligonucleotide"
auacuugaacagucuuaaaccuu

SEQ ID NO: 517 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaugctacuugaacagucuuaa

SEQ ID NO: 518 - RNA, 23 nt, Artificial Sequence
  source: /note="Description of Artificial Sequence: Synthetic oligonucleotide"
agaaugcuacuugaacagucuua

SEQ ID NO: 519 - RNA, 23 nt, Artificial Sequence
  source: /note="Description of Artificial Sequence: Synthetic oligonucleotide"
aauuggaaugcuacuugaacagu

SEQ ID NO: 520 - RNA, 23 nt, Artificial Sequence
  source: /note="Description of Artificial Sequence: Synthetic oligonucleotide"
aagauuggaaugcuacuugaaca

SEQ ID NO: 521 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaggtugagauaaagcugccu

SEQ ID NO: 522 - RNA, 23 nt, Artificial Sequence
  source: /note="Description of Artificial Sequence: Synthetic oligonucleotide"
uagggaaaucuuucaaaugcuga

SEQ ID NO: 523 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggctagggaaaucuuucaaa

SEQ ID NO: 524 - RNA, 23 nt, Artificial Sequence
  source: /note="Description of Artificial Sequence: Synthetic oligonucleotide"
aagaggcuagggaaaucuuucaa

SEQ ID NO: 525 - RNA, 23 nt, Artificial Sequence
  source: /note="Description of Artificial Sequence: Synthetic oligonucleotide"
aaaaaggaagaggcuagggaaau

SEQ ID NO: 526 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augcactcauucuguguucuugu

SEQ ID NO: 527 - RNA, 23 nt, Artificial Sequence
  source: /note="Description of Artificial Sequence: Synthetic oligonucleotide"
augugcacucauucuguguucuu

SEQ ID NO: 528 - RNA, 23 nt, Artificial Sequence
  source: /note="Description of Artificial Sequence: Synthetic oligonucleotide"
acugugcacucauucuguguucu

SEQ ID NO: 529 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuagctgugcacucauucugug

SEQ ID NO: 530 - RNA, 23 nt, Artificial Sequence
  source: /note="Description of Artificial Sequence: Synthetic oligonucleotide"
aucuuagcugugcacucauucug

SEQ ID NO: 531 - RNA, 23 nt, Artificial Sequence
  source: /note="Description of Artificial Sequence: Synthetic oligonucleotide"
agaaaucuuucaaaugcugaauc

SEQ ID NO: 532 - RNA, 23 nt, Artificial Sequence
  source: /note="Description of Artificial Sequence: Synthetic oligonucleotide"
acuagggaaaucuuucaaaugcu

SEQ ID NO: 533 - RNA, 23 nt, Artificial Sequence
  source: /note="Description of Artificial Sequence: Synthetic oligonucleotide"
agcuagggaaaucuuucaaaugc

SEQ ID NO: 534 - RNA, 23 nt, Artificial Sequence
  source: /note="Description of Artificial Sequence: Synthetic oligonucleotide"
agaauagaguugcaccguuuugg

SEQ ID NO: 535 - RNA, 23 nt, Artificial Sequence
  source: /note="Description of Artificial Sequence: Synthetic oligonucleotide"
aguccagaauagaguugcaccgu

SEQ ID NO: 536 - RNA, 23 nt, Artificial Sequence
  source: /note="Description of Artificial Sequence: Synthetic oligonucleotide"
aaguccagaauagaguugcaccg

SEQ ID NO: 537 - RNA, 23 nt, Artificial Sequence
  source: /note="Description of Artificial Sequence: Synthetic oligonucleotide"
aaaguccagaauagaguugcacc

SEQ ID NO: 538 - RNA, 23 nt, Artificial Sequence
  source: /note="Description of Artificial Sequence: Synthetic oligonucleotide"
uaaaguccagaauagaguugcac

SEQ ID NO: 539 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaagtccagaauagaguugca

SEQ ID NO: 540 - RNA, 23 nt, Artificial Sequence
  source: /note="Description of Artificial Sequence: Synthetic oligonucleotide"
aauaaaguccagaauagaguugc

SEQ ID NO: 541 - RNA, 23 nt, Artificial Sequence
  source: /note="Description of Artificial Sequence: Synthetic oligonucleotide"
ucaaguaauaaaguccagaauag

SEQ ID NO: 542 - RNA, 23 nt, Artificial Sequence
  source: /note="Description of Artificial Sequence: Synthetic oligonucleotide"
aggguccacuuuugguggacuuc

SEQ ID NO: 543 - RNA, 23 nt, Artificial Sequence
  source: /note="Description of Artificial Sequence: Synthetic oligonucleotide"
auagaggguccacuuuuggugga

SEQ ID NO: 544 - RNA, 23 nt, Artificial Sequence
  source: /note="Description of Artificial Sequence: Synthetic oligonucleotide"
uauagaggguccacuuuuggugg

SEQ ID NO: 545 - RNA, 23 nt, Artificial Sequence
  source: /note="Description of Artificial Sequence: Synthetic oligonucleotide"
auauagaggguccacuuuuggug

SEQ ID NO: 546 - RNA, 23 nt, Artificial Sequence
  source: /note="Description of Artificial Sequence: Synthetic oligonucleotide"
aauauagaggguccacuuuuggu

SEQ ID NO: 547 - RNA, 23 nt, Artificial Sequence
  source: /note="Description of Artificial Sequence: Synthetic oligonucleotide"
aaauauagaggguccacuuuugg

SEQ ID NO: 548 - RNA, 23 nt, Artificial Sequence
  source: /note="Description of Artificial Sequence: Synthetic oligonucleotide"
aagaauagaguugcaccguuuug

SEQ ID NO: 549 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagaatagaguugcaccguuuu

SEQ ID NO: 550 - RNA, 23 nt, Artificial Sequence
  source: /note="Description of Artificial Sequence: Synthetic oligonucleotide"
aaaguaauaaaguccagaauaga

SEQ ID NO: 551 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
gaaauatagaggguccacuuuug

SEQ ID NO: 552 - RNA, 23 nt, Artificial Sequence
  source: /note="Description of Artificial Sequence: Synthetic oligonucleotide"
agaaauauagaggguccacuuuu

SEQ ID NO: 553 - RNA, 23 nt, Artificial Sequence
  source: /note="Description of Artificial Sequence: Synthetic oligonucleotide"
agccuaaaauugucuaaacaucu

SEQ ID NO: 554 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagcctaaaauugucuaaacau

SEQ ID NO: 555 - RNA, 23 nt, Artificial Sequence
  source: /note="Description of Artificial Sequence: Synthetic oligonucleotide"
uugagccuaaaauugucuaaaca

SEQ ID NO: 556 - RNA, 23 nt, Artificial Sequence
  source: /note="Description of Artificial Sequence: Synthetic oligonucleotide"
uuugagccuaaaauugucuaaac

SEQ ID NO: 557 - RNA, 23 nt, Artificial Sequence
  source: /note="Description of Artificial Sequence: Synthetic oligonucleotide"
uuuugagccuaaaauugucuaaa

SEQ ID NO: 558 - RNA, 23 nt, Artificial Sequence
  source: /note="Description of Artificial Sequence: Synthetic oligonucleotide"
uuuuugagccuaaaauugucuaa

SEQ ID NO: 559 - RNA, 23 nt, Artificial Sequence
  source: /note="Description of Artificial Sequence: Synthetic oligonucleotide"
auuuuugagccuaaaauugucua

SEQ ID NO: 560 - RNA, 23 nt, Artificial Sequence
  source: /note="Description of Artificial Sequence: Synthetic oligonucleotide"
agcuuuaauuuuugagccuaaaa

SEQ ID NO: 561 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuutaauuuuugagccuaaa

SEQ ID NO: 562 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuagcutuaauuuuugagccuaa

SEQ ID NO: 563 - RNA, 23 nt, Artificial Sequence
  source: /note="Description of Artificial Sequence: Synthetic oligonucleotide"
uguuagcuuuaauuuuugagccu

SEQ ID NO: 564 - RNA, 23 nt, Artificial Sequence
  source: /note="Description of Artificial Sequence: Synthetic oligonucleotide"
uguguuagcuuuaauuuuugagc

SEQ ID NO: 565 - RNA, 23 nt, Artificial Sequence
  source: /note="Description of Artificial Sequence: Synthetic oligonucleotide"
augggaccaaggauauaugaaag

SEQ ID NO: 566 - RNA, 23 nt, Artificial Sequence
  source: /note="Description of Artificial Sequence: Synthetic oligonucleotide"
accuaaaauugucuaaacaucuc

SEQ ID NO: 567 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuagctuuaauuuuugagccua

SEQ ID NO: 568 - RNA, 23 nt, Artificial Sequence
  source: /note="Description of Artificial Sequence: Synthetic oligonucleotide"
auguuagcuuuaauuuuugagcc

SEQ ID NO: 569 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augugutagcuuuaauuuuugag

SEQ ID NO: 570 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuccugtguuagcuuuaauuuuu

SEQ ID NO: 571 - RNA, 23 nt, Artificial Sequence
  source: /note="Description of Artificial Sequence: Synthetic oligonucleotide"
acaguuccuuuuccuguguuagc

SEQ ID NO: 572 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agccagtacaguuccuuuuccug

SEQ ID NO: 573 - RNA, 23 nt, Artificial Sequence
  source: /note="Description of Artificial Sequence: Synthetic oligonucleotide"
auagccaguacaguuccuuuucc

SEQ ID NO: 574 - RNA, 23 nt, Artificial Sequence
  source: /note="Description of Artificial Sequence: Synthetic oligonucleotide"
uguaauagccaguacaguuccuu

SEQ ID NO: 575 - RNA, 23 nt, Artificial Sequence
  source: /note="Description of Artificial Sequence: Synthetic oligonucleotide"
acaguacaguuccuuuuccugug

SEQ ID NO: 576 - RNA, 23 nt, Artificial Sequence
  source: /note="Description of Artificial Sequence: Synthetic oligonucleotide"
auaauagccaguacaguuccuuu

SEQ ID NO: 577 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaguctugauguagugggaguc

SEQ ID NO: 578 - RNA, 23 nt, Artificial Sequence
  source: /note="Description of Artificial Sequence: Synthetic oligonucleotide"
auuagucuugauguagugggagu

SEQ ID NO: 579 - RNA, 23 nt, Artificial Sequence
  source: /note="Description of Artificial Sequence: Synthetic oligonucleotide"
agauuagucuugauguaguggga

SEQ ID NO: 580 - RNA, 23 nt, Artificial Sequence
  source: /note="Description of Artificial Sequence: Synthetic oligonucleotide"
aagauuagucuugauguaguggg

SEQ ID NO: 581 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaagatuagucuugauguagug

SEQ ID NO: 582 - RNA, 23 nt, Artificial Sequence
  source: /note="Description of Artificial Sequence: Synthetic oligonucleotide"
aacaagauuagucuugauguagu

SEQ ID NO: 583 - RNA, 23 nt, Artificial Sequence
  source: /note="Description of Artificial Sequence: Synthetic oligonucleotide"
aaacaagauuagucuugauguag

SEQ ID NO: 584 - RNA, 23 nt, Artificial Sequence
  source: /note="Description of Artificial Sequence: Synthetic oligonucleotide"
uauaauacaugugaaaaacacac

SEQ ID NO: 585 - RNA, 23 nt, Artificial Sequence
  source: /note="Description of Artificial Sequence: Synthetic oligonucleotide"
agcauucuauaauacaugugaaa

SEQ ID NO: 586 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcautcuauaauacaugugaa

SEQ ID NO: 587 - RNA, 23 nt, Artificial Sequence
  source: /note="Description of Artificial Sequence: Synthetic oligonucleotide"
ugcaaaagcauucuauaauacau

SEQ ID NO: 588 - RNA, 23 nt, Artificial Sequence
  source: /note="Description of Artificial Sequence: Synthetic oligonucleotide"
uccaugcaaaagcauucuauaau

SEQ ID NO: 589 - RNA, 23 nt, Artificial Sequence
  source: /note="Description of Artificial Sequence: Synthetic oligonucleotide"
uaguccaugcaaaagcauucuau

SEQ ID NO: 590 - RNA, 23 nt, Artificial Sequence
  source: /note="Description of Artificial Sequence: Synthetic oligonucleotide"
auaguccaugcaaaagcauucua

SEQ ID NO: 591 - RNA, 23 nt, Artificial Sequence
  source: /note="Description of Artificial Sequence: Synthetic oligonucleotide"
aggauaguccaugcaaaagcauu

SEQ ID NO: 592 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggataguccaugcaaaagca

SEQ ID NO: 593 - RNA, 23 nt, Artificial Sequence
  source: /note="Description of Artificial Sequence: Synthetic oligonucleotide"
acaagaggauaguccaugcaaaa

SEQ ID NO: 594 - RNA, 23 nt, Artificial Sequence
  source: /note="Description of Artificial Sequence: Synthetic oligonucleotide"
aacaagaggauaguccaugcaaa

SEQ ID NO: 595 - RNA, 23 nt, Artificial Sequence
  source: /note="Description of Artificial Sequence: Synthetic oligonucleotide"
aaacaagaggauaguccaugcaa

SEQ ID NO: 596 - RNA, 23 nt, Artificial Sequence
  source: /note="Description of Artificial Sequence: Synthetic oligonucleotide"
auaaaaacaagaggauaguccau

SEQ ID NO: 597 - RNA, 23 nt, Artificial Sequence
  source: /note="Description of Artificial Sequence: Synthetic oligonucleotide"
aauaaaaacaagaggauagucca

SEQ ID NO: 598 - RNA, 23 nt, Artificial Sequence
  source: /note="Description of Artificial Sequence: Synthetic oligonucleotide"
uuaauaaaaacaagaggauaguc

SEQ ID NO: 599 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuagtcuugauguagugggag

SEQ ID NO: 600 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagautagucuugauguagugg

SEQ ID NO: 601 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauagtccaugcaaaagcauuc

SEQ ID NO: 602 - RNA, 23 nt, Artificial Sequence
  source: /note="Description of Artificial Sequence: Synthetic oligonucleotide"
acaguaccuccucccuaggacua

SEQ ID NO: 603 - RNA, 23 nt, Artificial Sequence
  source: /note="Description of Artificial Sequence: Synthetic oligonucleotide"
aauccuucugcuucugaucacca

SEQ ID NO: 604 - RNA, 23 nt, Artificial Sequence
  source: /note="Description of Artificial Sequence: Synthetic oligonucleotide"
accaucaucuacuccuacuugga

SEQ ID NO: 605 - RNA, 23 nt, Artificial Sequence
  source: /note="Description of Artificial Sequence: Synthetic oligonucleotide"
caucuacuccuacuuggagucgu

SEQ ID NO: 606 - RNA, 23 nt, Artificial Sequence
  source: /note="Description of Artificial Sequence: Synthetic oligonucleotide"
aucuacuccuacuuggagucguu

SEQ ID NO: 607 - RNA, 23 nt, Artificial Sequence
  source: /note="Description of Artificial Sequence: Synthetic oligonucleotide"
caguaccuccucccuaggacuac

SEQ ID NO: 608 - RNA, 23 nt, Artificial Sequence
  source: /note="Description of Artificial Sequence: Synthetic oligonucleotide"
cuacacaaggacugaaccagaag

SEQ ID NO: 609 - RNA, 23 nt, Artificial Sequence
  source: /note="Description of Artificial Sequence: Synthetic oligonucleotide"
ucaccaucaucuacuccuacuug

SEQ ID NO: 610 - RNA, 23 nt, Artificial Sequence
  source: /note="Description of Artificial Sequence: Synthetic oligonucleotide"
caccaucaucuacuccuacuugg

SEQ ID NO: 611 - RNA, 23 nt, Artificial Sequence
  source: /note="Description of Artificial Sequence: Synthetic oligonucleotide"
ccaucaucuacuccuacuuggag

SEQ ID NO: 612 - RNA, 23 nt, Artificial Sequence
  source: /note="Description of Artificial Sequence: Synthetic oligonucleotide"
aucaucuacuccuacuuggaguc

SEQ ID NO: 613 - RNA, 23 nt, Artificial Sequence
  source: /note="Description of Artificial Sequence: Synthetic oligonucleotide"
ucuacuccuacuuggagucguug

SEQ ID NO: 614 - RNA, 23 nt, Artificial Sequence
  source: /note="Description of Artificial Sequence: Synthetic oligonucleotide"
cuacuccuacuuggagucguugg

SEQ ID NO: 615 - RNA, 23 nt, Artificial Sequence
  source: /note="Description of Artificial Sequence: Synthetic oligonucleotide"
uacuccuacuuggagucguuggu

SEQ ID NO: 616 - RNA, 23 nt, Artificial Sequence
  source: /note="Description of Artificial Sequence: Synthetic oligonucleotide"
acuccuacuuggagucguuggug

SEQ ID NO: 617 - RNA, 23 nt, Artificial Sequence
  source: /note="Description of Artificial Sequence: Synthetic oligonucleotide"
gaaacugcagcugagugccgaaa

SEQ ID NO: 618 - RNA, 23 nt, Artificial Sequence
  source: /note="Description of Artificial Sequence: Synthetic oligonucleotide"
aaacugcagcugagugccgaaaa

SEQ ID NO: 619 - RNA, 23 nt, Artificial Sequence
  source: /note="Description of Artificial Sequence: Synthetic oligonucleotide"
acugcagcugagugccgaaaacu

SEQ ID NO: 620 - RNA, 23 nt, Artificial Sequence
  source: /note="Description of Artificial Sequence: Synthetic oligonucleotide"
cugcagcugagugccgaaaacua

SEQ ID NO: 621 - RNA, 23 nt, Artificial Sequence
  source: /note="Description of Artificial Sequence: Synthetic oligonucleotide"
ugagugccgaaaacuaggcguca

SEQ ID NO: 622 - RNA, 23 nt, Artificial Sequence
  source: /note="Description of Artificial Sequence: Synthetic oligonucleotide"
agugccgaaaacuaggcgucacu

SEQ ID NO: 623 - RNA, 23 nt, Artificial Sequence
  source: /note="Description of Artificial Sequence: Synthetic oligonucleotide"
uucugugggauauuaauaagcgc

SEQ ID NO: 624 - RNA, 23 nt, Artificial Sequence
  source: /note="Description of Artificial Sequence: Synthetic oligonucleotide"
aacugcagcugagugccgaaaac

SEQ ID NO: 625 - RNA, 23 nt, Artificial Sequence
  source: /note="Description of Artificial Sequence: Synthetic oligonucleotide"
ugcagcugagugccgaaaacuag

SEQ ID NO: 626 - RNA, 23 nt, Artificial Sequence
  source: /note="Description of Artificial Sequence: Synthetic oligonucleotide"
gcagcugagugccgaaaacuagg

SEQ ID NO: 627 - RNA, 23 nt, Artificial Sequence
  source: /note="Description of Artificial Sequence: Synthetic oligonucleotide"
cagcugagugccgaaaacuaggc

SEQ ID NO: 628 - RNA, 23 nt, Artificial Sequence
  source: /note="Description of Artificial Sequence: Synthetic oligonucleotide"
agcugagugccgaaaacuaggcg

SEQ ID NO: 629 - RNA, 23 nt, Artificial Sequence
  source: /note="Description of Artificial Sequence: Synthetic oligonucleotide"
cugagugccgaaaacuaggcguc

SEQ ID NO: 630 - RNA, 23 nt, Artificial Sequence
  source: /note="Description of Artificial Sequence: Synthetic oligonucleotide"
gagugccgaaaacuaggcgucac

SEQ ID NO: 631 - RNA, 23 nt, Artificial Sequence
  source: /note="Description of Artificial Sequence: Synthetic oligonucleotide"
gugccgaaaacuaggcgucacug

SEQ ID NO: 632 - RNA, 23 nt, Artificial Sequence
  source: /note="Description of Artificial Sequence: Synthetic oligonucleotide"
ugccgaaaacuaggcgucacugc

SEQ ID NO: 633 - RNA, 23 nt, Artificial Sequence
  source: /note="Description of Artificial Sequence: Synthetic oligonucleotide"
aaacuaggcgucacugcgcaugc

SEQ ID NO: 634 - RNA, 23 nt, Artificial Sequence
  source: /note="Description of Artificial Sequence: Synthetic oligonucleotide"
gagaucuaucgcucucuaaauca

SEQ ID NO: 635 - RNA, 23 nt, Artificial Sequence
  source: /note="Description of Artificial Sequence: Synthetic oligonucleotide"
aucuaucgcucucuaaaucaggu

SEQ ID NO: 636 - RNA, 23 nt, Artificial Sequence
  source: /note="Description of Artificial Sequence: Synthetic oligonucleotide"
cuaucgcucucuaaaucagguga

SEQ ID NO: 637 - RNA, 23 nt, Artificial Sequence
  source: /note="Description of Artificial Sequence: Synthetic oligonucleotide"
uaucgcucucuaaaucaggugaa

SEQ ID NO: 638 - RNA, 23 nt, Artificial Sequence
  source: /note="Description of Artificial Sequence: Synthetic oligonucleotide"
gcucucuaaaucaggugaagaaa

SEQ ID NO: 639 - RNA, 23 nt, Artificial Sequence
  source: /note="Description of Artificial Sequence: Synthetic oligonucleotide"
ucguggugaauaaugcugggaca

SEQ ID NO: 640 - RNA, 23 nt, Artificial Sequence
  source: /note="Description of Artificial Sequence: Synthetic oligonucleotide"
gugaauaaugcugggacaguaua

SEQ ID NO: 641 - RNA, 23 nt, Artificial Sequence
  source: /note="Description of Artificial Sequence: Synthetic oligonucleotide"
ugaauaaugcugggacaguauau

SEQ ID NO: 642 - RNA, 23 nt, Artificial Sequence
  source: /note="Description of Artificial Sequence: Synthetic oligonucleotide"
cugggacaguauauccagccgau

SEQ ID NO: 643 - RNA, 23 nt, Artificial Sequence
  source: /note="Description of Artificial Sequence: Synthetic oligonucleotide"
gggacaguauauccagccgaucu

SEQ ID NO: 644 - RNA, 23 nt, Artificial Sequence
  source: /note="Description of Artificial Sequence: Synthetic oligonucleotide"
ggacaguauauccagccgaucuu

SEQ ID NO: 645 - RNA, 23 nt, Artificial Sequence
  source: /note="Description of Artificial Sequence: Synthetic oligonucleotide"
acaguauauccagccgaucuucu

SEQ ID NO: 646 - RNA, 23 nt, Artificial Sequence
  source: /note="Description of Artificial Sequence: Synthetic oligonucleotide"
agaucuaucgcucucuaaaucag

SEQ ID NO: 647 - RNA, 23 nt, Artificial Sequence
  source: /note="Description of Artificial Sequence: Synthetic oligonucleotide"
ucuaucgcucucuaaaucaggug

SEQ ID NO: 648 - RNA, 23 nt, Artificial Sequence
  source: /note="Description of Artificial Sequence: Synthetic oligonucleotide"
aucgcucucuaaaucaggugaag

SEQ ID NO: 649 - RNA, 23 nt, Artificial Sequence
  source: /note="Description of Artificial Sequence: Synthetic oligonucleotide"
aucguggugaauaaugcugggac

SEQ ID NO: 650 - RNA, 23 nt, Artificial Sequence
  source: /note="Description of Artificial Sequence: Synthetic oligonucleotide"
cguggugaauaaugcugggacag

SEQ ID NO: 651 - RNA, 23 nt, Artificial Sequence
  source: /note="Description of Artificial Sequence: Synthetic oligonucleotide"
uaaugcugggacaguauauccag

SEQ ID NO: 652 - RNA, 23 nt, Artificial Sequence
  source: /note="Description of Artificial Sequence: Synthetic oligonucleotide"
aaugcugggacaguauauccagc

SEQ ID NO: 653 - RNA, 23 nt, Artificial Sequence
  source: /note="Description of Artificial Sequence: Synthetic oligonucleotide"
augcugggacaguauauccagcc

SEQ ID NO: 654 - RNA, 23 nt, Artificial Sequence
  source: /note="Description of Artificial Sequence: Synthetic oligonucleotide"
ugcugggacaguauauccagccg

SEQ ID NO: 655 - RNA, 23 nt, Artificial Sequence
  source: /note="Description of Artificial Sequence: Synthetic oligonucleotide"
ugggacaguauauccagccgauc

SEQ ID NO: 656 - RNA, 23 nt, Artificial Sequence
  source: /note="Description of Artificial Sequence: Synthetic oligonucleotide"
gacaguauauccagccgaucuuc

SEQ ID NO: 657 - RNA, 23 nt, Artificial Sequence
  source: /note="Description of Artificial Sequence: Synthetic oligonucleotide"
caccaaggaugaagagauuacca

SEQ ID NO: 658 - RNA, 23 nt, Artificial Sequence
  source: /note="Description of Artificial Sequence: Synthetic oligonucleotide"
accaaggaugaagagauuaccaa

SEQ ID NO: 659 - RNA, 23 nt, Artificial Sequence
  source: /note="Description of Artificial Sequence: Synthetic oligonucleotide"
cauuugaggucaacauccuagga

SEQ ID NO: 660 - RNA, 23 nt, Artificial Sequence
  source: /note="Description of Artificial Sequence: Synthetic oligonucleotide"
uuugaggucaacauccuaggaca

SEQ ID NO: 661 - RNA, 23 nt, Artificial Sequence
  source: /note="Description of Artificial Sequence: Synthetic oligonucleotide"
uugaggucaacauccuaggacau

SEQ ID NO: 662 - RNA, 23 nt, Artificial Sequence
  source: /note="Description of Artificial Sequence: Synthetic oligonucleotide"
gaggucaacauccuaggacauuu

SEQ ID NO: 663 - RNA, 23 nt, Artificial Sequence
  source: /note="Description of Artificial Sequence: Synthetic oligonucleotide"
aggucaacauccuaggacauuuu

SEQ ID NO: 664 - RNA, 23 nt, Artificial Sequence
  source: /note="Description of Artificial Sequence: Synthetic oligonucleotide"
caacauccuaggacauuuuugga

SEQ ID NO: 665 - RNA, 23 nt, Artificial Sequence
  source: /note="Description of Artificial Sequence: Synthetic oligonucleotide"
aacauccuaggacauuuuuggau

SEQ ID NO: 666 - RNA, 23 nt, Artificial Sequence
  source: /note="Description of Artificial Sequence: Synthetic oligonucleotide"
cauccuaggacauuuuuggauca

SEQ ID NO: 667 - RNA, 23 nt, Artificial Sequence
  source: /note="Description of Artificial Sequence: Synthetic oligonucleotide"
cuaggacauuuuuggaucacaaa

SEQ ID NO: 668 - RNA, 23 nt, Artificial Sequence
  source: /note="Description of Artificial Sequence: Synthetic oligonucleotide"
uaggacauuuuuggaucacaaaa

SEQ ID NO: 669 - RNA, 23 nt, Artificial Sequence
  source: /note="Description of Artificial Sequence: Synthetic oligonucleotide"
cauuuuuggaucacaaaagcacu

SEQ ID NO: 670 - RNA, 23 nt, Artificial Sequence
  source: /note="Description of Artificial Sequence: Synthetic oligonucleotide"
uuuggaucacaaaagcacuucuu

SEQ ID NO: 671 - RNA, 23 nt, Artificial Sequence
  source: /note="Description of Artificial Sequence: Synthetic oligonucleotide"
cacaaaagcacuucuuccaucga

SEQ ID NO: 672 - RNA, 23 nt, Artificial Sequence
  source: /note="Description of Artificial Sequence: Synthetic oligonucleotide"
acaaaagcacuucuuccaucgau

SEQ ID NO: 673 - RNA, 23 nt, Artificial Sequence
  source: /note="Description of Artificial Sequence: Synthetic oligonucleotide"
aaaagcacuucuuccaucgauga

SEQ ID NO: 674 - RNA, 23 nt, Artificial Sequence
  source: /note="Description of Artificial Sequence: Synthetic oligonucleotide"
aaagcacuucuuccaucgaugau

SEQ ID NO: 675 - RNA, 23 nt, Artificial Sequence
  source: /note="Description of Artificial Sequence: Synthetic oligonucleotide"
auggagagaaaucauggccacau

SEQ ID NO: 676 - RNA, 23 nt, Artificial Sequence
  source: /note="Description of Artificial Sequence: Synthetic oligonucleotide"
gcaccaaggaugaagagauuacc

SEQ ID NO: 677 - RNA, 23 nt, Artificial Sequence
  source: /note="Description of Artificial Sequence: Synthetic oligonucleotide"
caagacauuugaggucaacaucc

SEQ ID NO: 678 - RNA, 23 nt, Artificial Sequence
  source: /note="Description of Artificial Sequence: Synthetic oligonucleotide"
gacauuugaggucaacauccuag

SEQ ID NO: 679 - RNA, 23 nt, Artificial Sequence
  source: /note="Description of Artificial Sequence: Synthetic oligonucleotide"
acauuugaggucaacauccuagg

SEQ ID NO: 680 - RNA, 23 nt, Artificial Sequence
  source: /note="Description of Artificial Sequence: Synthetic oligonucleotide"
auuugaggucaacauccuaggac

SEQ ID NO: 681 - RNA, 23 nt, Artificial Sequence
  source: /note="Description of Artificial Sequence: Synthetic oligonucleotide"
gucaacauccuaggacauuuuug

SEQ ID NO: 682 - RNA, 23 nt, Artificial Sequence
  source: /note="Description of Artificial Sequence: Synthetic oligonucleotide"
ucaacauccuaggacauuuuugg

SEQ ID NO: 683 - RNA, 23 nt, Artificial Sequence
  source: /note="Description of Artificial Sequence: Synthetic oligonucleotide"
acauccuaggacauuuuuggauc

SEQ ID NO: 684 - RNA, 23 nt, Artificial Sequence
  source: /note="Description of Artificial Sequence: Synthetic oligonucleotide"
auccuaggacauuuuuggaucac

SEQ ID NO: 685 - RNA, 23 nt, Artificial Sequence
  source: /note="Description of Artificial Sequence: Synthetic oligonucleotide"
aggacauuuuuggaucacaaaag

SEQ ID NO: 686 - RNA, 23 nt, Artificial Sequence
  source: /note="Description of Artificial Sequence: Synthetic oligonucleotide"
uuggaucacaaaagcacuucuuc

SEQ ID NO: 687 - RNA, 23 nt, Artificial Sequence
  source: /note="Description of Artificial Sequence: Synthetic oligonucleotide"
aucacaaaagcacuucuuccauc

SEQ ID NO: 688 - RNA, 23 nt, Artificial Sequence
  source: /note="Description of Artificial Sequence: Synthetic oligonucleotide"
ucacaaaagcacuucuuccaucg

SEQ ID NO: 689 - RNA, 23 nt, Artificial Sequence
  source: /note="Description of Artificial Sequence: Synthetic oligonucleotide"
caaaagcacuucuuccaucgaug

SEQ ID NO: 690 - RNA, 23 nt, Artificial Sequence
  source: /note="Description of Artificial Sequence: Synthetic oligonucleotide"
aagcacuucuuccaucgaugaug

SEQ ID NO: 691 - RNA, 23 nt, Artificial Sequence
  source: /note="Description of Artificial Sequence: Synthetic oligonucleotide"
agagaaaucauggccacaucguc

SEQ ID NO: 692 - RNA, 23 nt, Artificial Sequence
  source: /note="Description of Artificial Sequence: Synthetic oligonucleotide"
agaaaucauggccacaucgucac

SEQ ID NO: 693 - RNA, 23 nt, Artificial Sequence
  source: /note="Description of Artificial Sequence: Synthetic oligonucleotide"
gauuccuuaccucaucccauauu

SEQ ID NO: 694 - RNA, 23 nt, Artificial Sequence
  source: /note="Description of Artificial Sequence: Synthetic oligonucleotide"
uuaccucaucccauauuguucca

SEQ ID NO: 695 - RNA, 23 nt, Artificial Sequence
  source: /note="Description of Artificial Sequence: Synthetic oligonucleotide"
ccucaucccauauuguuccagca

SEQ ID NO: 696 - RNA, 23 nt, Artificial Sequence
  source: /note="Description of Artificial Sequence: Synthetic oligonucleotide"
cucaucccauauuguuccagcaa

SEQ ID NO: 697 - RNA, 23 nt, Artificial Sequence
  source: /note="Description of Artificial Sequence: Synthetic oligonucleotide"
caucccauauuguuccagcaaau

SEQ ID NO: 698 - RNA, 23 nt, Artificial Sequence
  source: /note="Description of Artificial Sequence: Synthetic oligonucleotide"
aucccauauuguuccagcaaauu

SEQ ID NO: 699 - RNA, 23 nt, Artificial Sequence
  source: /note="Description of Artificial Sequence: Synthetic oligonucleotide"
gcuguuggcuuucacagaggucu

SEQ ID NO: 700 - RNA, 23 nt, Artificial Sequence
  source: /note="Description of Artificial Sequence: Synthetic oligonucleotide"
uuggcuuucacagaggucugaca

SEQ ID NO: 701 - RNA, 23 nt, Artificial Sequence
  source: /note="Description of Artificial Sequence: Synthetic oligonucleotide"
uggcuuucacagaggucugacau

SEQ ID NO: 702 - RNA, 23 nt, Artificial Sequence
  source: /note="Description of Artificial Sequence: Synthetic oligonucleotide"
uucacagaggucugacaucagaa

SEQ ID NO: 703 - RNA, 23 nt, Artificial Sequence
  source: /note="Description of Artificial Sequence: Synthetic oligonucleotide"
agaggucugacaucagaacuuca

SEQ ID NO: 704 - RNA, 23 nt, Artificial Sequence
  source: /note="Description of Artificial Sequence: Synthetic oligonucleotide"
auuccuuaccucaucccauauug

SEQ ID NO: 705 - RNA, 23 nt, Artificial Sequence
  source: /note="Description of Artificial Sequence: Synthetic oligonucleotide"
cuuucacagaggucugacaucag

SEQ ID NO: 706 - RNA, 23 nt, Artificial Sequence
  source: /note="Description of Artificial Sequence: Synthetic oligonucleotide"
ccuugggaaaaacugguaucaaa

SEQ ID NO: 707 - RNA, 23 nt, Artificial Sequence
  source: /note="Description of Artificial Sequence: Synthetic oligonucleotide"
aaacugguaucaaaaccucaugu

SEQ ID NO: 708 - RNA, 23 nt, Artificial Sequence
  source: /note="Description of Artificial Sequence: Synthetic oligonucleotide"
acugguaucaaaaccucaugucu

SEQ ID NO: 709 - RNA, 23 nt, Artificial Sequence
  source: /note="Description of Artificial Sequence: Synthetic oligonucleotide"
gucucugcccaguuuuugugaau

SEQ ID NO: 710 - RNA, 23 nt, Artificial Sequence
  source: /note="Description of Artificial Sequence: Synthetic oligonucleotide"
aguuuuugugaauacuggguuca

SEQ ID NO: 711 - RNA, 23 nt, Artificial Sequence
  source: /note="Description of Artificial Sequence: Synthetic oligonucleotide"
uuuugugaauacuggguucacca

SEQ ID NO: 712 - RNA, 23 nt, Artificial Sequence
  source: /note="Description of Artificial Sequence: Synthetic oligonucleotide"
uuugugaauacuggguucaccaa

SEQ ID NO: 713 - RNA, 23 nt, Artificial Sequence
  source: /note="Description of Artificial Sequence: Synthetic oligonucleotide"
ugugaauacuggguucaccaaaa

SEQ ID NO: 714 - RNA, 23 nt, Artificial Sequence
  source: /note="Description of Artificial Sequence: Synthetic oligonucleotide"
gugaauacuggguucaccaaaaa

SEQ ID NO: 715 - RNA, 23 nt, Artificial Sequence
  source: /note="Description of Artificial Sequence: Synthetic oligonucleotide"
ugaauacuggguucaccaaaaau

SEQ ID NO: 716 - RNA, 23 nt, Artificial Sequence
  source: /note="Description of Artificial Sequence: Synthetic oligonucleotide"
ccaaaaauccaagcacaagauua

SEQ ID NO: 717 - RNA, 23 nt, Artificial Sequence
  source: /note="Description of Artificial Sequence: Synthetic oligonucleotide"
caaaaauccaagcacaagauuau

SEQ ID NO: 718 - RNA, 23 nt, Artificial Sequence
  source: /note="Description of Artificial Sequence: Synthetic oligonucleotide"
caagcacaagauuauggccugua

SEQ ID NO: 719 - RNA, 23 nt, Artificial Sequence
  source: /note="Description of Artificial Sequence: Synthetic oligonucleotide"
aagcacaagauuauggccuguau

SEQ ID NO: 720 - RNA, 23 nt, Artificial Sequence
  source: /note="Description of Artificial Sequence: Synthetic oligonucleotide"
agcacaagauuauggccuguauu

SEQ ID NO: 721 - RNA, 23 nt, Artificial Sequence
  source: /note="Description of Artificial Sequence: Synthetic oligonucleotide"
acaagauuauggccuguauugga

SEQ ID NO: 722 - RNA, 23 nt, Artificial Sequence
  source: /note="Description of Artificial Sequence: Synthetic oligonucleotide"
aagauuauggccuguauuggaga

SEQ ID NO: 723 - RNA, 23 nt, Artificial Sequence
  source: /note="Description of Artificial Sequence: Synthetic oligonucleotide"
gauuauggccuguauuggagaca

SEQ ID NO: 724 - RNA, 23 nt, Artificial Sequence
  source: /note="Description of Artificial Sequence: Synthetic oligonucleotide"
uauggccuguauuggagacagau

SEQ ID NO: 725 - RNA, 23 nt, Artificial Sequence
  source: /note="Description of Artificial Sequence: Synthetic oligonucleotide"
uggccuguauuggagacagauga

SEQ ID NO: 726 - RNA, 23 nt, Artificial Sequence
  source: /note="Description of Artificial Sequence: Synthetic oligonucleotide"
aacugguaucaaaaccucauguc

SEQ ID NO: 727 - RNA, 23 nt, Artificial Sequence
  source: /note="Description of Artificial Sequence: Synthetic oligonucleotide"
cugguaucaaaaccucaugucuc

SEQ ID NO: 728 - RNA, 23 nt, Artificial Sequence
  source: /note="Description of Artificial Sequence: Synthetic oligonucleotide"
uaucaaaaccucaugucucugcc

SEQ ID NO: 729 - RNA, 23 nt, Artificial Sequence
  source: /note="Description of Artificial Sequence: Synthetic oligonucleotide"
ugcccaguuuuugugaauacugg

SEQ ID NO: 730 - RNA, 23 nt, Artificial Sequence
  source: /note="Description of Artificial Sequence: Synthetic oligonucleotide"
guuuuugugaauacuggguucac

SEQ ID NO: 731 - RNA, 23 nt, Artificial Sequence
  source: /note="Description of Artificial Sequence: Synthetic oligonucleotide"
uuuuugugaauacuggguucacc

SEQ ID NO: 732 - RNA, 23 nt, Artificial Sequence
  source: /note="Description of Artificial Sequence: Synthetic oligonucleotide"
gaauacuggguucaccaaaaauc

SEQ ID NO: 733 - RNA, 23 nt, Artificial Sequence
  source: /note="Description of Artificial Sequence: Synthetic oligonucleotide"
aauacuggguucaccaaaaaucc

SEQ ID NO: 734 - RNA, 23 nt, Artificial Sequence
  source: /note="Description of Artificial Sequence: Synthetic oligonucleotide"
uucaccaaaaauccaagcacaag

SEQ ID NO: 735 - RNA, 23 nt, Artificial Sequence
  source: /note="Description of Artificial Sequence: Synthetic oligonucleotide"
aaaaauccaagcacaagauuaug

SEQ ID NO: 736 - RNA, 23 nt, Artificial Sequence
  source: /note="Description of Artificial Sequence: Synthetic oligonucleotide"
aaaauccaagcacaagauuaugg

SEQ ID NO: 737 - RNA, 23 nt, Artificial Sequence
  source: /note="Description of Artificial Sequence: Synthetic oligonucleotide"
aaauccaagcacaagauuauggc

SEQ ID NO: 738 - RNA, 23 nt, Artificial Sequence
  source: /note="Description of Artificial Sequence: Synthetic oligonucleotide"
aauccaagcacaagauuauggcc

SEQ ID NO: 739 - RNA, 23 nt, Artificial Sequence
  source: /note="Description of Artificial Sequence: Synthetic oligonucleotide"
gcacaagauuauggccuguauug

SEQ ID NO: 740 - RNA, 23 nt, Artificial Sequence
  source: /note="Description of Artificial Sequence: Synthetic oligonucleotide"
cacaagauuauggccuguauugg

SEQ ID NO: 741 - RNA, 23 nt, Artificial Sequence
  source: /note="Description of Artificial Sequence: Synthetic oligonucleotide"
agauuauggccuguauuggagac

SEQ ID NO: 742 - RNA, 23 nt, Artificial Sequence
  source: /note="Description of Artificial Sequence: Synthetic oligonucleotide"
auggccuguauuggagacagaug

SEQ ID NO: 743 - RNA, 23 nt, Artificial Sequence
  source: /note="Description of Artificial Sequence: Synthetic oligonucleotide"
ucguaagaagucugauagaugga

SEQ ID NO: 744 - RNA, 23 nt, Artificial Sequence
  source: /note="Description of Artificial Sequence: Synthetic oligonucleotide"
cguaagaagucugauagauggaa

SEQ ID NO: 745 - RNA, 23 nt, Artificial Sequence
  source: /note="Description of Artificial Sequence: Synthetic oligonucleotide"
guaagaagucugauagauggaau

SEQ ID NO: 746 - RNA, 23 nt, Artificial Sequence
  source: /note="Description of Artificial Sequence: Synthetic oligonucleotide"
uaagaagucugauagauggaaua

SEQ ID NO: 747 - RNA, 23 nt, Artificial Sequence
  source: /note="Description of Artificial Sequence: Synthetic oligonucleotide"
agaagucugauagauggaauacu

SEQ ID NO: 748 - RNA, 23 nt, Artificial Sequence
  source: /note="Description of Artificial Sequence: Synthetic oligonucleotide"
auagauggaauacuuaccaauaa

SEQ ID NO: 749 - RNA, 23 nt, Artificial Sequence
  source: /note="Description of Artificial Sequence: Synthetic oligonucleotide"
agauggaauacuuaccaauaaga

SEQ ID NO: 750 - RNA, 23 nt, Artificial Sequence
  source: /note="Description of Artificial Sequence: Synthetic oligonucleotide"
gauggaauacuuaccaauaagaa

SEQ ID NO: 751 - RNA, 23 nt, Artificial Sequence
  source: /note="Description of Artificial Sequence: Synthetic oligonucleotide"
auggaauacuuaccaauaagaaa

SEQ ID NO: 752 - RNA, 23 nt, Artificial Sequence
  source: /note="Description of Artificial Sequence: Synthetic oligonucleotide"
uggaauacuuaccaauaagaaaa

SEQ ID NO: 753 - RNA, 23 nt, Artificial Sequence
  source: /note="Description of Artificial Sequence: Synthetic oligonucleotide"
ggaauacuuaccaauaagaaaau

SEQ ID NO: 754 - RNA, 23 nt, Artificial Sequence
  source: /note="Description of Artificial Sequence: Synthetic oligonucleotide"
aguuucuuccugaacgcgccuca

SEQ ID NO: 755 - RNA, 23 nt, Artificial Sequence
  source: /note="Description of Artificial Sequence: Synthetic oligonucleotide"
gcgauuuuaaaucguaugcagaa

SEQ ID NO: 756 - RNA, 23 nt, Artificial Sequence
  source: /note="Description of Artificial Sequence: Synthetic oligonucleotide"
gauuuuaaaucguaugcagaaua

SEQ ID NO: 757 - RNA, 23 nt, Artificial Sequence
  source: /note="Description of Artificial Sequence: Synthetic oligonucleotide"
uuaaaucguaugcagaauauuca

SEQ ID NO: 758 - RNA, 23 nt, Artificial Sequence
  source: /note="Description of Artificial Sequence: Synthetic oligonucleotide"
aaaucguaugcagaauauucaau

SEQ ID NO: 759 - RNA, 23 nt, Artificial Sequence
  source: /note="Description of Artificial Sequence: Synthetic oligonucleotide"
aaucguaugcagaauauucaauu

SEQ ID NO: 760 - RNA, 23 nt, Artificial Sequence
  source: /note="Description of Artificial Sequence: Synthetic oligonucleotide"
aucguaugcagaauauucaauuu

SEQ ID NO: 761 - RNA, 23 nt, Artificial Sequence
  source: /note="Description of Artificial Sequence: Synthetic oligonucleotide"
guaugcagaauauucaauuugaa

SEQ ID NO: 762 - RNA, 23 nt, Artificial Sequence
  source: /note="Description of Artificial Sequence: Synthetic oligonucleotide"
aagaagucugauagauggaauac

SEQ ID NO: 763 - RNA, 23 nt, Artificial Sequence
  source: /note="Description of Artificial Sequence: Synthetic oligonucleotide"
agucugauagauggaauacuuac

SEQ ID NO: 764 - RNA, 23 nt, Artificial Sequence
  source: /note="Description of Artificial Sequence: Synthetic oligonucleotide"
uagauggaauacuuaccaauaag

SEQ ID NO: 765 - RNA, 23 nt, Artificial Sequence
  source: /note="Description of Artificial Sequence: Synthetic oligonucleotide"
cuacagaaguuucuuccugaacg

SEQ ID NO: 766 - RNA, 23 nt, Artificial Sequence
  source: /note="Description of Artificial Sequence: Synthetic oligonucleotide"
acagaaguuucuuccugaacgcg

SEQ ID NO: 767 - RNA, 23 nt, Artificial Sequence
  source: /note="Description of Artificial Sequence: Synthetic oligonucleotide"
agaaguuucuuccugaacgcgcc

SEQ ID NO: 768 - RNA, 23 nt, Artificial Sequence
  source: /note="Description of Artificial Sequence: Synthetic oligonucleotide"
aaguuucuuccugaacgcgccuc

SEQ ID NO: 769 - RNA, 23 nt, Artificial Sequence
  source: /note="Description of Artificial Sequence: Synthetic oligonucleotide"
uuucuuccugaacgcgccucagc

SEQ ID NO: 770 - RNA, 23 nt, Artificial Sequence
  source: /note="Description of Artificial Sequence: Synthetic oligonucleotide"
augcagaauauucaauuugaagc

SEQ ID NO: 771 - RNA, 23 nt, Artificial Sequence
  source: /note="Description of Artificial Sequence: Synthetic oligonucleotide"
agaauauucaauuugaagcagug

SEQ ID NO: 772 - RNA, 23 nt, Artificial Sequence
  source: /note="Description of Artificial Sequence: Synthetic oligonucleotide"
aauauucaauuugaagcaguggu

SEQ ID NO: 773 - RNA, 23 nt, Artificial Sequence
  source: /note="Description of Artificial Sequence: Synthetic oligonucleotide"
gagauguaugcaugauaaugaua

SEQ ID NO: 774 - RNA, 23 nt, Artificial Sequence
  source: /note="Description of Artificial Sequence: Synthetic oligonucleotide"
aucaaugcugcaaagcuuuauuu

SEQ ID NO: 775 - RNA, 23 nt, Artificial Sequence
  source: /note="Description of Artificial Sequence: Synthetic oligonucleotide"
gcaaagcuuuauuucacauuuuu

SEQ ID NO: 776 - RNA, 23 nt, Artificial Sequence
  source: /note="Description of Artificial Sequence: Synthetic oligonucleotide"
ucaauuugaagcagugguuggcc

SEQ ID NO: 777 - RNA, 23 nt, Artificial Sequence
  source: /note="Description of Artificial Sequence: Synthetic oligonucleotide"
ucaaugcugcaaagcuuuauuuc

SEQ ID NO: 778 - RNA, 23 nt, Artificial Sequence
  source: /note="Description of Artificial Sequence: Synthetic oligonucleotide"
aaugcugcaaagcuuuauuucac

SEQ ID NO: 779 - RNA, 23 nt, Artificial Sequence
  source: /note="Description of Artificial Sequence: Synthetic oligonucleotide"
uuaaaaacauugguuuggcacua

SEQ ID NO: 780 - RNA, 23 nt, Artificial Sequence
  source: /note="Description of Artificial Sequence: Synthetic oligonucleotide"
caagauuaauuaccugucuuccu

SEQ ID NO: 781 - RNA, 23 nt, Artificial Sequence
  source: /note="Description of Artificial Sequence: Synthetic oligonucleotide"
agauuaauuaccugucuuccugu

SEQ ID NO: 782 - RNA, 23 nt, Artificial Sequence
  source: /note="Description of Artificial Sequence: Synthetic oligonucleotide"
auuaauuaccugucuuccuguuu

SEQ ID NO: 783 - RNA, 23 nt, Artificial Sequence
  source: /note="Description of Artificial Sequence: Synthetic oligonucleotide"
auuaccugucuuccuguuucuca

SEQ ID NO: 784 - RNA, 23 nt, Artificial Sequence
  source: /note="Description of Artificial Sequence: Synthetic oligonucleotide"
uuaccugucuuccuguuucucaa

SEQ ID NO: 785 - RNA, 23 nt, Artificial Sequence
  source: /note="Description of Artificial Sequence: Synthetic oligonucleotide"
ugucuuccuguuucucaagaaua

SEQ ID NO: 786 - RNA, 23 nt, Artificial Sequence
  source: /note="Description of Artificial Sequence: Synthetic oligonucleotide"
guuuuuccuuucaugccucuuaa

SEQ ID NO: 787 - RNA, 23 nt, Artificial Sequence
  source: /note="Description of Artificial Sequence: Synthetic oligonucleotide"
uuuccuuucaugccucuuaaaaa

SEQ ID NO: 788 - RNA, 23 nt, Artificial Sequence
  source: /note="Description of Artificial Sequence: Synthetic oligonucleotide"
uccuuucaugccucuuaaaaacu

SEQ ID NO: 789 - RNA, 23 nt, Artificial Sequence
  source: /note="Description of Artificial Sequence: Synthetic oligonucleotide"
uaaaaacauugguuuggcacuag

SEQ ID NO: 790 - RNA, 23 nt, Artificial Sequence
  source: /note="Description of Artificial Sequence: Synthetic oligonucleotide"
aagauuaauuaccugucuuccug

SEQ ID NO: 791 - RNA, 23 nt, Artificial Sequence
  source: /note="Description of Artificial Sequence: Synthetic oligonucleotide"
aauuaccugucuuccuguuucuc

SEQ ID NO: 792 - RNA, 23 nt, Artificial Sequence
  source: /note="Description of Artificial Sequence: Synthetic oligonucleotide"
uaccugucuuccuguuucucaag

SEQ ID NO: 793 - RNA, 23 nt, Artificial Sequence
  source: /note="Description of Artificial Sequence: Synthetic oligonucleotide"
uaggucuguuuuuccuuucaugc

SEQ ID NO: 794 - RNA, 23 nt, Artificial Sequence
  source: /note="Description of Artificial Sequence: Synthetic oligonucleotide"
aggucuguuuuuccuuucaugcc

SEQ ID NO: 795 - RNA, 23 nt, Artificial Sequence
  source: /note="Description of Artificial Sequence: Synthetic oligonucleotide"
acuuauuuacacagggaagguuu

SEQ ID NO: 796 - RNA, 23 nt, Artificial Sequence
  source: /note="Description of Artificial Sequence: Synthetic oligonucleotide"
cuuauuuacacagggaagguuua

SEQ ID NO: 797 - RNA, 23 nt, Artificial Sequence
  source: /note="Description of Artificial Sequence: Synthetic oligonucleotide"
auuuacacagggaagguuuaaga

SEQ ID NO: 798 - RNA, 23 nt, Artificial Sequence
  source: /note="Description of Artificial Sequence: Synthetic oligonucleotide"
uuacacagggaagguuuaagacu

SEQ ID NO: 799 - RNA, 23 nt, Artificial Sequence
  source: /note="Description of Artificial Sequence: Synthetic oligonucleotide"
cagggaagguuuaagacuguuca

SEQ ID NO: 800 - RNA, 23 nt, Artificial Sequence
  source: /note="Description of Artificial Sequence: Synthetic oligonucleotide"
agggaagguuuaagacuguucaa

SEQ ID NO: 801 - RNA, 23 nt, Artificial Sequence
  source: /note="Description of Artificial Sequence: Synthetic oligonucleotide"
gaagguuuaagacuguucaagua

SEQ ID NO: 802 - RNA, 23 nt, Artificial Sequence
  source: /note="Description of Artificial Sequence: Synthetic oligonucleotide"
gguuuaagacuguucaaguagca

SEQ ID NO: 803 - RNA, 23 nt, Artificial Sequence
  source: /note="Description of Artificial Sequence: Synthetic oligonucleotide"
uuuaagacuguucaaguagcauu

SEQ ID NO: 804 - RNA, 23 nt, Artificial Sequence
  source: /note="Description of Artificial Sequence: Synthetic oligonucleotide"
aagacuguucaaguagcauucca

SEQ ID NO: 805 - RNA, 23 nt, Artificial Sequence
  source: /note="Description of Artificial Sequence: Synthetic oligonucleotide"
agacuguucaaguagcauuccaa

SEQ ID NO: 806 - RNA, 23 nt, Artificial Sequence
  source: /note="Description of Artificial Sequence: Synthetic oligonucleotide"
gacuguucaaguagcauuccaau

SEQ ID NO: 807 - RNA, 23 nt, Artificial Sequence
  source: /note="Description of Artificial Sequence: Synthetic oligonucleotide"
cuguucaaguagcauuccaaucu

SEQ ID NO: 808 - RNA, 23 nt, Artificial Sequence
  source: /note="Description of Artificial Sequence: Synthetic oligonucleotide"
uucaaguagcauuccaaucugua

SEQ ID NO: 809 - RNA, 23 nt, Artificial Sequence
  source: /note="Description of Artificial Sequence: Synthetic oligonucleotide"
aguagcauuccaaucuguagcca

SEQ ID NO: 810 - RNA, 23 nt, Artificial Sequence
  source: /note="Description of Artificial Sequence: Synthetic oligonucleotide"
guagcauuccaaucuguagccau

SEQ ID NO: 811 - RNA, 23 nt, Artificial Sequence
  source: /note="Description of Artificial Sequence: Synthetic oligonucleotide"
agaacuuauuuacacagggaagg

SEQ ID NO: 812 - RNA, 23 nt, Artificial Sequence
  source: /note="Description of Artificial Sequence: Synthetic oligonucleotide"
uuuacacagggaagguuuaagac

SEQ ID NO: 813 - RNA, 23 nt, Artificial Sequence
  source: /note="Description of Artificial Sequence: Synthetic oligonucleotide"
uacacagggaagguuuaagacug

SEQ ID NO: 814 - RNA, 23 nt, Artificial Sequence
  source: /note="Description of Artificial Sequence: Synthetic oligonucleotide"
acagggaagguuuaagacuguuc

SEQ ID NO: 815 - RNA, 23 nt, Artificial Sequence
  source: /note="Description of Artificial Sequence: Synthetic oligonucleotide"
gggaagguuuaagacuguucaag

SEQ ID NO: 816 - RNA, 23 nt, Artificial Sequence
  source: /note="Description of Artificial Sequence: Synthetic oligonucleotide"
aagguuuaagacuguucaaguag

SEQ ID NO: 817 - RNA, 23 nt, Artificial Sequence
  source: /note="Description of Artificial Sequence: Synthetic oligonucleotide"
uuaagacuguucaaguagcauuc

SEQ ID NO: 818 - RNA, 23 nt, Artificial Sequence
  source: /note="Description of Artificial Sequence: Synthetic oligonucleotide"
uaagacuguucaaguagcauucc

SEQ ID NO: 819 - RNA, 23 nt, Artificial Sequence
  source: /note="Description of Artificial Sequence: Synthetic oligonucleotide"
acuguucaaguagcauuccaauc

SEQ ID NO: 820 - RNA, 23 nt, Artificial Sequence
  source: /note="Description of Artificial Sequence: Synthetic oligonucleotide"
uguucaaguagcauuccaaucug

SEQ ID NO: 821 - RNA, 23 nt, Artificial Sequence
  source: /note="Description of Artificial Sequence: Synthetic oligonucleotide"
aggcagcuuuaucucaaccugga

SEQ ID NO: 822 - RNA, 23 nt, Artificial Sequence
  source: /note="Description of Artificial Sequence: Synthetic oligonucleotide"
ucagcauuugaaagauuucccua

SEQ ID NO: 823 - RNA, 23 nt, Artificial Sequence
  source: /note="Description of Artificial Sequence: Synthetic oligonucleotide"
uuugaaagauuucccuagccucu

SEQ ID NO: 824 - RNA, 23 nt, Artificial Sequence
  source: /note="Description of Artificial Sequence: Synthetic oligonucleotide"
uugaaagauuucccuagccucuu

SEQ ID NO: 825 - RNA, 23 nt, Artificial Sequence
  source: /note="Description of Artificial Sequence: Synthetic oligonucleotide"
auuucccuagccucuuccuuuuu

SEQ ID NO: 826 - RNA, 23 nt, Artificial Sequence
  source: /note="Description of Artificial Sequence: Synthetic oligonucleotide"
acaagaacacagaaugagugcac

SEQ ID NO: 827 - RNA, 23 nt, Artificial Sequence
  source: /note="Description of Artificial Sequence: Synthetic oligonucleotide"
aagaacacagaaugagugcacag

SEQ ID NO: 828 - RNA, 23 nt, Artificial Sequence
  source: /note="Description of Artificial Sequence: Synthetic oligonucleotide"
agaacacagaaugagugcacagc

SEQ ID NO: 829 - RNA, 23 nt, Artificial Sequence
  source: /note="Description of Artificial Sequence: Synthetic oligonucleotide"
cacagaaugagugcacagcuaag

SEQ ID NO: 830 - RNA, 23 nt, Artificial Sequence
  source: /note="Description of Artificial Sequence: Synthetic oligonucleotide"
cagaaugagugcacagcuaagag

SEQ ID NO: 831 - RNA, 23 nt, Artificial Sequence
  source: /note="Description of Artificial Sequence: Synthetic oligonucleotide"
gauucagcauuugaaagauuucc

SEQ ID NO: 832 - RNA, 23 nt, Artificial Sequence
  source: /note="Description of Artificial Sequence: Synthetic oligonucleotide"
agcauuugaaagauuucccuagc

SEQ ID NO: 833 - RNA, 23 nt, Artificial Sequence
  source: /note="Description of Artificial Sequence: Synthetic oligonucleotide"
gcauuugaaagauuucccuagcc

SEQ ID NO: 834 - RNA, 23 nt, Artificial Sequence
  source: /note="Description of Artificial Sequence: Synthetic oligonucleotide"
ccaaaacggugcaacucuauucu

SEQ ID NO: 835 - RNA, 23 nt, Artificial Sequence
  source: /note="Description of Artificial Sequence: Synthetic oligonucleotide"
acggugcaacucuauucuggacu

SEQ ID NO: 836 - RNA, 23 nt, Artificial Sequence
  source: /note="Description of Artificial Sequence: Synthetic oligonucleotide"
cggugcaacucuauucuggacuu

SEQ ID NO: 837 - RNA, 23 nt, Artificial Sequence
  source: /note="Description of Artificial Sequence: Synthetic oligonucleotide"
ggugcaacucuauucuggacuuu

SEQ ID NO: 838 - RNA, 23 nt, Artificial Sequence
  source: /note="Description of Artificial Sequence: Synthetic oligonucleotide"
gugcaacucuauucuggacuuua

SEQ ID NO: 839 - RNA, 23 nt, Artificial Sequence
  source: /note="Description of Artificial Sequence: Synthetic oligonucleotide"
ugcaacucuauucuggacuuuau

SEQ ID NO: 840 - RNA, 23 nt, Artificial Sequence
  source: /note="Description of Artificial Sequence: Synthetic oligonucleotide"
gcaacucuauucuggacuuuauu

SEQ ID NO: 841 - RNA, 23 nt, Artificial Sequence
  source: /note="Description of Artificial Sequence: Synthetic oligonucleotide"
cuauucuggacuuuauuacuuga

SEQ ID NO: 842 - RNA, 23 nt, Artificial Sequence
  source: /note="Description of Artificial Sequence: Synthetic oligonucleotide"
gaaguccaccaaaaguggacccu

SEQ ID NO: 843 - RNA, 23 nt, Artificial Sequence
  source: /note="Description of Artificial Sequence: Synthetic oligonucleotide"
uccaccaaaaguggacccucuau

SEQ ID NO: 844 - RNA, 23 nt, Artificial Sequence
  source: /note="Description of Artificial Sequence: Synthetic oligonucleotide"
ccaccaaaaguggacccucuaua

SEQ ID NO: 845 - RNA, 23 nt, Artificial Sequence
  source: /note="Description of Artificial Sequence: Synthetic oligonucleotide"
caccaaaaguggacccucuauau

SEQ ID NO: 846 - RNA, 23 nt, Artificial Sequence
  source: /note="Description of Artificial Sequence: Synthetic oligonucleotide"
accaaaaguggacccucuauauu

SEQ ID NO: 847 - RNA, 23 nt, Artificial Sequence
  source: /note="Description of Artificial Sequence: Synthetic oligonucleotide"
ccaaaaguggacccucuauauuu

SEQ ID NO: 848 - RNA, 23 nt, Artificial Sequence
  source: /note="Description of Artificial Sequence: Synthetic oligonucleotide"
caaaacggugcaacucuauucug

SEQ ID NO: 849 - RNA, 23 nt, Artificial Sequence
  source: /note="Description of Artificial Sequence: Synthetic oligonucleotide"
aaaacggugcaacucuauucugg

SEQ ID NO: 850 - RNA, 23 nt, Artificial Sequence
  source: /note="Description of Artificial Sequence: Synthetic oligonucleotide"
ucuauucuggacuuuauuacuug

SEQ ID NO: 851 - RNA, 23 nt, Artificial Sequence
  source: /note="Description of Artificial Sequence: Synthetic oligonucleotide"
caaaaguggacccucuauauuuc

SEQ ID NO: 852 - RNA, 23 nt, Artificial Sequence
  source: /note="Description of Artificial Sequence: Synthetic oligonucleotide"
aaaaguggacccucuauauuucc

SEQ ID NO: 853 - RNA, 23 nt, Artificial Sequence
  source: /note="Description of Artificial Sequence: Synthetic oligonucleotide"
agauguuuagacaauuuuaggcu

SEQ ID NO: 854 - RNA, 23 nt, Artificial Sequence
  source: /note="Description of Artificial Sequence: Synthetic oligonucleotide"
auguuuagacaauuuuaggcuca

SEQ ID NO: 855 - RNA, 23 nt, Artificial Sequence
  source: /note="Description of Artificial Sequence: Synthetic oligonucleotide"
uguuuagacaauuuuaggcucaa

SEQ ID NO: 856 - RNA, 23 nt, Artificial Sequence
  source: /note="Description of Artificial Sequence: Synthetic oligonucleotide"
guuuagacaauuuuaggcucaaa

SEQ ID NO: 857 - RNA, 23 nt, Artificial Sequence
  source: /note="Description of Artificial Sequence: Synthetic oligonucleotide"
uuuagacaauuuuaggcucaaaa

SEQ ID NO: 858 - RNA, 23 nt, Artificial Sequence
  source: /note="Description of Artificial Sequence: Synthetic oligonucleotide"
uuagacaauuuuaggcucaaaaa

SEQ ID NO: 859 - RNA, 23 nt, Artificial Sequence
  source: /note="Description of Artificial Sequence: Synthetic oligonucleotide"
uagacaauuuuaggcucaaaaau

SEQ ID NO: 860 - RNA, 23 nt, Artificial Sequence
  source: /note="Description of Artificial Sequence: Synthetic oligonucleotide"
uuuuaggcucaaaaauuaaagcu

SEQ ID NO: 861 - RNA, 23 nt, Artificial Sequence
  source: /note="Description of Artificial Sequence: Synthetic oligonucleotide"
uuuaggcucaaaaauuaaagcua

SEQ ID NO: 862 - RNA, 23 nt, Artificial Sequence
  source: /note="Description of Artificial Sequence: Synthetic oligonucleotide"
uuaggcucaaaaauuaaagcuaa

SEQ ID NO: 863 - RNA, 23 nt, Artificial Sequence
  source: /note="Description of Artificial Sequence: Synthetic oligonucleotide"
aggcucaaaaauuaaagcuaaca

SEQ ID NO: 864 - RNA, 23 nt, Artificial Sequence
  source: /note="Description of Artificial Sequence: Synthetic oligonucleotide"
gcucaaaaauuaaagcuaacaca

SEQ ID NO: 865 - RNA, 23 nt, Artificial Sequence
  source: /note="Description of Artificial Sequence: Synthetic oligonucleotide"
cuuucauauauccuuggucccag

SEQ ID NO: 866 - RNA, 23 nt, Artificial Sequence
  source: /note="Description of Artificial Sequence: Synthetic oligonucleotide"
gagauguuuagacaauuuuaggc

SEQ ID NO: 867 - RNA, 23 nt, Artificial Sequence
  source: /note="Description of Artificial Sequence: Synthetic oligonucleotide"
uaggcucaaaaauuaaagcuaac

SEQ ID NO: 868 - RNA, 23 nt, Artificial Sequence
  source: /note="Description of Artificial Sequence: Synthetic oligonucleotide"
ggcucaaaaauuaaagcuaacac

SEQ ID NO: 869 - RNA, 23 nt, Artificial Sequence
  source: /note="Description of Artificial Sequence: Synthetic oligonucleotide"
cucaaaaauuaaagcuaacacag

SEQ ID NO: 870 - RNA, 23 nt, Artificial Sequence
  source: /note="Description of Artificial Sequence: Synthetic oligonucleotide"
aaaaauuaaagcuaacacaggaa

SEQ ID NO: 871 - RNA, 23 nt, Artificial Sequence
  source: /note="Description of Artificial Sequence: Synthetic oligonucleotide"
gcuaacacaggaaaaggaacugu

SEQ ID NO: 872 - RNA, 23 nt, Artificial Sequence
  source: /note="Description of Artificial Sequence: Synthetic oligonucleotide"
caggaaaaggaacuguacuggcu

SEQ ID NO: 873 - RNA, 23 nt, Artificial Sequence
  source: /note="Description of Artificial Sequence: Synthetic oligonucleotide"
ggaaaaggaacuguacuggcuau

SEQ ID NO: 874 - RNA, 23 nt, Artificial Sequence
  source: /note="Description of Artificial Sequence: Synthetic oligonucleotide"
aaggaacuguacuggcuauuaca

SEQ ID NO: 875 - RNA, 23 nt, Artificial Sequence
  source: /note="Description of Artificial Sequence: Synthetic oligonucleotide"
cacaggaaaaggaacuguacugg

SEQ ID NO: 876 - RNA, 23 nt, Artificial Sequence
  source: /note="Description of Artificial Sequence: Synthetic oligonucleotide"
aaaggaacuguacuggcuauuac

SEQ ID NO: 877 - RNA, 23 nt, Artificial Sequence
  source: /note="Description of Artificial Sequence: Synthetic oligonucleotide"
gacucccacuacaucaagacuaa

SEQ ID NO: 878 - RNA, 23 nt, Artificial Sequence
  source: /note="Description of Artificial Sequence: Synthetic oligonucleotide"
acucccacuacaucaagacuaau

SEQ ID NO: 879 - RNA, 23 nt, Artificial Sequence
  source: /note="Description of Artificial Sequence: Synthetic oligonucleotide"
ucccacuacaucaagacuaaucu

SEQ ID NO: 880 - RNA, 23 nt, Artificial Sequence
  source: /note="Description of Artificial Sequence: Synthetic oligonucleotide"
cccacuacaucaagacuaaucuu

SEQ ID NO: 881 - RNA, 23 nt, Artificial Sequence
  source: /note="Description of Artificial Sequence: Synthetic oligonucleotide"
cacuacaucaagacuaaucuugu

SEQ ID NO: 882 - RNA, 23 nt, Artificial Sequence
  source: /note="Description of Artificial Sequence: Synthetic oligonucleotide"
acuacaucaagacuaaucuuguu

SEQ ID NO: 883 - RNA, 23 nt, Artificial Sequence
  source: /note="Description of Artificial Sequence: Synthetic oligonucleotide"
cuacaucaagacuaaucuuguuu

SEQ ID NO: 884 - RNA, 23 nt, Artificial Sequence
  source: /note="Description of Artificial Sequence: Synthetic oligonucleotide"
guguguuuuucacauguauuaua

SEQ ID NO: 885 - RNA, 23 nt, Artificial Sequence
  source: /note="Description of Artificial Sequence: Synthetic oligonucleotide"
uuucacauguauuauagaaugcu

SEQ ID NO: 886 - RNA, 23 nt, Artificial Sequence
  source: /note="Description of Artificial Sequence: Synthetic oligonucleotide"
uucacauguauuauagaaugcuu

SEQ ID NO: 887 - RNA, 23 nt, Artificial Sequence
  source: /note="Description of Artificial Sequence: Synthetic oligonucleotide"
auguauuauagaaugcuuuugca

SEQ ID NO: 888 - RNA, 23 nt, Artificial Sequence
  source: /note="Description of Artificial Sequence: Synthetic oligonucleotide"
auuauagaaugcuuuugcaugga

SEQ ID NO: 889 - RNA, 23 nt, Artificial Sequence
  source: /note="Description of Artificial Sequence: Synthetic oligonucleotide"
auagaaugcuuuugcauggacua

SEQ ID NO: 890 - RNA, 23 nt, Artificial Sequence
  source: /note="Description of Artificial Sequence: Synthetic oligonucleotide"
uagaaugcuuuugcauggacuau

SEQ ID NO: 891 - RNA, 23 nt, Artificial Sequence
  source: /note="Description of Artificial Sequence: Synthetic oligonucleotide"
aaugcuuuugcauggacuauccu

SEQ ID NO: 892 - RNA, 23 nt, Artificial Sequence
  source: /note="Description of Artificial Sequence: Synthetic oligonucleotide"
ugcuuuugcauggacuauccucu

SEQ ID NO: 893 - RNA, 23 nt, Artificial Sequence
  source: /note="Description of Artificial Sequence: Synthetic oligonucleotide"
uuuugcauggacuauccucuugu

SEQ ID NO: 894 - RNA, 23 nt, Artificial Sequence
  source: /note="Description of Artificial Sequence: Synthetic oligonucleotide"
uuugcauggacuauccucuuguu

SEQ ID NO: 895 - RNA, 23 nt, Artificial Sequence
  source: /note="Description of Artificial Sequence: Synthetic oligonucleotide"
uugcauggacuauccucuuguuu

SEQ ID NO: 896 - RNA, 23 nt, Artificial Sequence
  source: /note="Description of Artificial Sequence: Synthetic oligonucleotide"
auggacuauccucuuguuuuuau

SEQ ID NO: 897 - RNA, 23 nt, Artificial Sequence
  source: /note="Description of Artificial Sequence: Synthetic oligonucleotide"
uggacuauccucuuguuuuuauu

SEQ ID NO: 898 - RNA, 23 nt, Artificial Sequence
  source: /note="Description of Artificial Sequence: Synthetic oligonucleotide"
gacuauccucuuguuuuuauuaa

SEQ ID NO: 899 - RNA, 23 nt, Artificial Sequence
  source: /note="Description of Artificial Sequence: Synthetic oligonucleotide"
cucccacuacaucaagacuaauc

SEQ ID NO: 900 - RNA, 23 nt, Artificial Sequence
  source: /note="Description of Artificial Sequence: Synthetic oligonucleotide"
ccacuacaucaagacuaaucuug

SEQ ID NO: 901 - RNA, 23 nt, Artificial Sequence
  source: /note="Description of Artificial Sequence: Synthetic oligonucleotide"
gaaugcuuuugcauggacuaucc

SEQ ID NO: 902 - RNA, 21 nt, Artificial Sequence
  source: /note="Description of Artificial Sequence: Synthetic oligonucleotide"
aguaccuccucccuaggacua

SEQ ID NO: 903 - RNA, 21 nt, Artificial Sequence
  source: /note="Description of Artificial Sequence: Synthetic oligonucleotide"
uccuucugcuucugaucacca

SEQ ID NO: 904 - RNA, 21 nt, Artificial Sequence
  source: /note="Description of Artificial Sequence: Synthetic oligonucleotide"
caucaucuacuccuacuugga

SEQ ID NO: 905 - skipped

SEQ ID NO: 906 - RNA, 21 nt, Artificial Sequence
  source: /note="Description of Artificial Sequence: Synthetic oligonucleotide"
cuacuccuacuuggagucguu

SEQ ID NO: 907 - RNA, 21 nt, Artificial Sequence
  source: /note="Description of Artificial Sequence: Synthetic oligonucleotide"
guaccuccucccuaggacuau

SEQ ID NO: 908 - RNA, 21 nt, Artificial Sequence
  source: /note="Description of Artificial Sequence: Synthetic oligonucleotide"
acacaaggacugaaccagaau

SEQ ID NO: 909 - RNA, 21 nt, Artificial Sequence
  source: /note="Description of Artificial Sequence: Synthetic oligonucleotide"
accaucaucuacuccuacuuu

SEQ ID NO: 910 - RNA, 21 nt, Artificial Sequence
  source: /note="Description of Artificial Sequence: Synthetic oligonucleotide"
ccaucaucuacuccuacuugu

SEQ ID NO: 911 - RNA, 21 nt, Artificial Sequence
  source: /note="Description of Artificial Sequence: Synthetic oligonucleotide"
aucaucuacuccuacuuggau

SEQ ID NO: 912 - RNA, 21 nt, Artificial Sequence
  source: /note="Description of Artificial Sequence: Synthetic oligonucleotide"
caucuacuccuacuuggaguu

SEQ ID NO: 913 - RNA, 21 nt, Artificial Sequence
  source: /note="Description of Artificial Sequence: Synthetic oligonucleotide"
uacuccuacuuggagucguuu

SEQ ID NO: 914 - RNA, 21 nt, Artificial Sequence
  source: /note="Description of Artificial Sequence: Synthetic oligonucleotide"
acuccuacuuggagucguugu

SEQ ID NO: 915 - skipped

SEQ ID NO: 916 - RNA, 21 nt, Artificial Sequence
  source: /note="Description of Artificial Sequence: Synthetic oligonucleotide"
uccuacuuggagucguugguu

SEQ ID NO: 917-919 - skipped (3 entries)

SEQ ID NO: 920 - RNA, 21 nt, Artificial Sequence
  source: /note="Description of Artificial Sequence: Synthetic oligonucleotide"
gcagcugagugccgaaaacua

SEQ ID NO: 921-922 - skipped (2 entries)

SEQ ID NO: 923 - RNA, 21 nt, Artificial Sequence
  source: /note="Description of Artificial Sequence: Synthetic oligonucleotide"
cugugggauauuaauaagcgu

SEQ ID NO: 924 - RNA, 21 nt, Artificial Sequence
  source: /note="Description of Artificial Sequence: Synthetic oligonucleotide"
cugcagcugagugccgaaaau

SEQ ID NO: 925 - RNA, 21 nt, Artificial Sequence
  source: /note="Description of Artificial Sequence: Synthetic oligonucleotide"
cagcugagugccgaaaacuau

SEQ ID NO: 926 - RNA, 21 nt, Artificial Sequence
  source: /note="Description of Artificial Sequence: Synthetic oligonucleotide"
agcugagugccgaaaacuagu

SEQ ID NO: 927 - RNA, 21 nt, Artificial Sequence
  source: /note="Description of Artificial Sequence: Synthetic oligonucleotide"
gcugagugccgaaaacuaggu

SEQ ID NO: 928 - RNA, 21 nt, Artificial Sequence
  source: /note="Description of Artificial Sequence: Synthetic oligonucleotide"
cugagugccgaaaacuaggcu

SEQ ID NO: 929 - RNA, 21 nt, Artificial Sequence
  source: /note="Description of Artificial Sequence: Synthetic oligonucleotide"
gagugccgaaaacuaggcguu

SEQ ID NO: 930 - RNA, 21 nt, Artificial Sequence
  source: /note="Description of Artificial Sequence: Synthetic oligonucleotide"
gugccgaaaacuaggcgucau

SEQ ID NO: 931 - RNA, 21 nt, Artificial Sequence
  source: /note="Description of Artificial Sequence: Synthetic oligonucleotide"
gccgaaaacuaggcgucacuu

SEQ ID NO: 932 - RNA, 21 nt, Artificial Sequence
  source: /note="Description of Artificial Sequence: Synthetic oligonucleotide"
ccgaaaacuaggcgucacugu

SEQ ID NO: 933 - RNA, 21 nt, Artificial Sequence
  source: /note="Description of Artificial Sequence: Synthetic oligonucleotide"
acuaggcgucacugcgcaugu

SEQ ID NO: 934 - skipped

SEQ ID NO: 935 - RNA, 21 nt, Artificial Sequence
  source: /note="Description of Artificial Sequence: Synthetic oligonucleotide"
cuaucgcucucuaaaucaggu

SEQ ID NO: 936 - skipped

SEQ ID NO: 937 - RNA, 21 nt, Artificial Sequence
  source: /note="Description of Artificial Sequence: Synthetic oligonucleotide"
ucgcucucuaaaucaggugaa

SEQ ID NO: 938 - RNA, 21 nt, Artificial Sequence
  source: /note="Description of Artificial Sequence: Synthetic oligonucleotide"
ucucuaaaucaggugaagaaa

SEQ ID NO: 939 - RNA, 21 nt, Artificial Sequence
  source: /note="Description of Artificial Sequence: Synthetic oligonucleotide"
guggugaauaaugcugggaca

SEQ ID NO: 940 - RNA, 21 nt, Artificial Sequence
  source: /note="Description of Artificial Sequence: Synthetic oligonucleotide"
gaauaaugcugggacaguaua

SEQ ID NO: 941 - RNA, 21 nt, Artificial Sequence
  source: /note="Description of Artificial Sequence: Synthetic oligonucleotide"
aauaaugcugggacaguauau

SEQ ID NO: 942 - RNA, 21 nt, Artificial Sequence
  source: /note="Description of Artificial Sequence: Synthetic oligonucleotide"
gggacaguauauccagccgau

SEQ ID NO: 943 - RNA, 21 nt, Artificial Sequence
  source: /note="Description of Artificial Sequence: Synthetic oligonucleotide"
gacaguauauccagccgaucu

SEQ ID NO: 944 - RNA, 21 nt, Artificial Sequence
  source: /note="Description of Artificial Sequence: Synthetic oligonucleotide"
acaguauauccagccgaucuu

SEQ ID NO: 945 - RNA, 21 nt, Artificial Sequence
  source: /note="Description of Artificial Sequence: Synthetic oligonucleotide"
aguauauccagccgaucuucu

SEQ ID NO: 946 - RNA, 21 nt, Artificial Sequence
  source: /note="Description of Artificial Sequence: Synthetic oligonucleotide"
aucuaucgcucucuaaaucau

SEQ ID NO: 947 - RNA, 21 nt, Artificial Sequence
  source: /note="Description of Artificial Sequence: Synthetic oligonucleotide"
uaucgcucucuaaaucagguu

SEQ ID NO: 948 - RNA, 21 nt, Artificial Sequence
  source: /note="Description of Artificial Sequence: Synthetic oligonucleotide"
cgcucucuaaaucaggugaau

SEQ ID NO: 949 - RNA, 21 nt, Artificial Sequence
  source: /note="Description of Artificial Sequence: Synthetic oligonucleotide"
cguggugaauaaugcugggau

SEQ ID NO: 950 - RNA, 21 nt, Artificial Sequence
  source: /note="Description of Artificial Sequence: Synthetic oligonucleotide"
uggugaauaaugcugggacau

SEQ ID NO: 951 - RNA, 21 nt, Artificial Sequence
  source: /note="Description of Artificial Sequence: Synthetic oligonucleotide"
augcugggacaguauauccau

SEQ ID NO: 952 - RNA, 21 nt, Artificial Sequence
  source: /note="Description of Artificial Sequence: Synthetic oligonucleotide"
ugcugggacaguauauccagu

SEQ ID NO: 953 - RNA, 21 nt, Artificial Sequence
  source: /note="Description of Artificial Sequence: Synthetic oligonucleotide"
gcugggacaguauauccagcu

SEQ ID NO: 954 - RNA, 21 nt, Artificial Sequence
  source: /note="Description of Artificial Sequence: Synthetic oligonucleotide"
cugggacaguauauccagccu

SEQ ID NO: 955 - RNA, 21 nt, Artificial Sequence
  source: /note="Description of Artificial Sequence: Synthetic oligonucleotide"
ggacaguauauccagccgauu

SEQ ID NO: 956 - RNA, 21 nt, Artificial Sequence
  source: /note="Description of Artificial Sequence: Synthetic oligonucleotide"
caguauauccagccgaucuuu

SEQ ID NO: 957 - RNA, 21 nt, Artificial Sequence
  source: /note="Description of Artificial Sequence: Synthetic oligonucleotide"
ccaaggaugaagagauuacca

SEQ ID NO: 958 - skipped

SEQ ID NO: 959 - RNA, 21 nt, Artificial Sequence
  source: /note="Description of Artificial Sequence: Synthetic oligonucleotide"
uuugaggucaacauccuagga

SEQ ID NO: 960 - RNA, 21 nt, Artificial Sequence
  source: /note="Description of Artificial Sequence: Synthetic oligonucleotide"
ugaggucaacauccuaggaca

SEQ ID NO: 961 - RNA, 21 nt, Artificial Sequence
  source: /note="Description of Artificial Sequence: Synthetic oligonucleotide"
gaggucaacauccuaggacau

SEQ ID NO: 962 - skipped

SEQ ID NO: 963 - RNA, 21 nt, Artificial Sequence
  source: /note="Description of Artificial Sequence: Synthetic oligonucleotide"
gucaacauccuaggacauuuu

SEQ ID NO: 964 - RNA, 21 nt, Artificial Sequence
  source: /note="Description of Artificial Sequence: Synthetic oligonucleotide"
acauccuaggacauuuuugga

SEQ ID NO: 965 - RNA, 21 nt, Artificial Sequence
  source: /note="Description of Artificial Sequence: Synthetic oligonucleotide"
cauccuaggacauuuuuggau

SEQ ID NO: 966 - skipped

SEQ ID NO: 967 - RNA, 21 nt, Artificial Sequence
  source: /note="Description of Artificial Sequence: Synthetic oligonucleotide"
aggacauuuuuggaucacaaa

SEQ ID NO: 968 - RNA, 21 nt, Artificial Sequence
  source: /note="Description of Artificial Sequence: Synthetic oligonucleotide"
ggacauuuuuggaucacaaaa

SEQ ID NO: 969 - RNA, 21 nt, Artificial Sequence
  source: /note="Description of Artificial Sequence: Synthetic oligonucleotide"
uuuuuggaucacaaaagcacu

SEQ ID NO: 970 - RNA, 21 nt, Artificial Sequence
  source: /note="Description of Artificial Sequence: Synthetic oligonucleotide"
uggaucacaaaagcacuucuu

SEQ ID NO: 971 - RNA, 21 nt, Artificial Sequence
  source: /note="Description of Artificial Sequence: Synthetic oligonucleotide"
caaaagcacuucuuccaucga

SEQ ID NO: 972 - RNA, 21 nt, Artificial Sequence
  source: /note="Description of Artificial Sequence: Synthetic oligonucleotide"
aaaagcacuucuuccaucgau

SEQ ID NO: 973-975 - skipped (3 entries)

SEQ ID NO: 976 - RNA, 21 nt, Artificial Sequence
  source: /note="Description of Artificial Sequence: Synthetic oligonucleotide"
accaaggaugaagagauuacu

SEQ ID NO: 977 - RNA, 21 nt, Artificial Sequence
  source: /note="Description of Artificial Sequence: Synthetic oligonucleotide"
agacauuugaggucaacaucu

SEQ ID NO: 978 - RNA, 21 nt, Artificial Sequence
  source: /note="Description of Artificial Sequence: Synthetic oligonucleotide"
cauuugaggucaacauccuau

SEQ ID NO: 979 - RNA, 21 nt, Artificial Sequence
  source: /note="Description of Artificial Sequence: Synthetic oligonucleotide"
auuugaggucaacauccuagu

SEQ ID NO: 980 - RNA, 21 nt, Artificial Sequence
  source: /note="Description of Artificial Sequence: Synthetic oligonucleotide"
uugaggucaacauccuaggau

SEQ ID NO: 981 - RNA, 21 nt, Artificial Sequence
  source: /note="Description of Artificial Sequence: Synthetic oligonucleotide"
caacauccuaggacauuuuug

SEQ ID NO: 982 - RNA, 21 nt, Artificial Sequence
  source: /note="Description of Artificial Sequence: Synthetic oligonucleotide"
aacauccuaggacauuuuugu

SEQ ID NO: 983 - RNA, 21 nt, Artificial Sequence
  source: /note="Description of Artificial Sequence: Synthetic oligonucleotide"
auccuaggacauuuuuggauu

SEQ ID NO: 984 - RNA, 21 nt, Artificial Sequence
  source: /note="Description of Artificial Sequence: Synthetic oligonucleotide"
ccuaggacauuuuuggaucau

SEQ ID NO: 985 - RNA, 21 nt, Artificial Sequence
  source: /note="Description of Artificial Sequence: Synthetic oligonucleotide"
gacauuuuuggaucacaaaau

SEQ ID NO: 986 - RNA, 21 nt, Artificial Sequence
  source: /note="Description of Artificial Sequence: Synthetic oligonucleotide"
ggaucacaaaagcacuucuuu

SEQ ID NO: 987 - RNA, 21 nt, Artificial Sequence
  source: /note="Description of Artificial Sequence: Synthetic oligonucleotide"
cacaaaagcacuucuuccauu

SEQ ID NO: 988 - RNA, 21 nt, Artificial Sequence
  source: /note="Description of Artificial Sequence: Synthetic oligonucleotide"
acaaaagcacuucuuccaucu

SEQ ID NO: 989 - RNA, 21 nt, Artificial Sequence
  source: /note="Description of Artificial Sequence: Synthetic oligonucleotide"
aaagcacuucuuccaucgauu

SEQ ID NO: 990 - RNA, 21 nt, Artificial Sequence
  source: /note="Description of Artificial Sequence: Synthetic oligonucleotide"
gcacuucuuccaucgaugauu

SEQ ID NO: 991 - RNA, 21 nt, Artificial Sequence
  source: /note="Description of Artificial Sequence: Synthetic oligonucleotide"
agaaaucauggccacaucguu

SEQ ID NO: 992 - RNA, 21 nt, Artificial Sequence
  source: /note="Description of Artificial Sequence: Synthetic oligonucleotide"
aaaucauggccacaucgucau

SEQ ID NO: 993 - RNA, 21 nt, Artificial Sequence
  source: /note="Description of Artificial Sequence: Synthetic oligonucleotide"
uuccuuaccucaucccauauu

SEQ ID NO: 994 - RNA, 21 nt, Artificial Sequence
  source: /note="Description of Artificial Sequence: Synthetic oligonucleotide"
accucaucccauauuguucca

SEQ ID NO: 995 - RNA, 21 nt, Artificial Sequence
  source: /note="Description of Artificial Sequence: Synthetic oligonucleotide"
ucaucccauauuguuccagca

SEQ ID NO: 996 - skipped

SEQ ID NO: 997 - RNA, 21 nt, Artificial Sequence
  source: /note="Description of Artificial Sequence: Synthetic oligonucleotide"
ucccauauuguuccagcaaau

SEQ ID NO: 998 - RNA, 21 nt, Artificial Sequence
  source: /note="Description of Artificial Sequence: Synthetic oligonucleotide"
cccauauuguuccagcaaauu

SEQ ID NO: 999 - RNA, 21 nt, Artificial Sequence
  source: /note="Description of Artificial Sequence: Synthetic oligonucleotide"
uguuggcuuucacagaggucu

SEQ ID NO: 1000 - RNA, 21 nt, Artificial Sequence
  source: /note="Description of Artificial Sequence: Synthetic oligonucleotide"
ggcuuucacagaggucugaca

SEQ ID NO: 1001 - skipped

SEQ ID NO: 1002 - RNA, 21 nt, Artificial Sequence
  source: /note="Description of Artificial Sequence: Synthetic oligonucleotide"
cacagaggucugacaucagaa

SEQ ID NO: 1003 - RNA, 21 nt, Artificial Sequence
  source: /note="Description of Artificial Sequence: Synthetic oligonucleotide"
aggucugacaucagaacuuca

SEQ ID NO: 1004 - RNA, 21 nt, Artificial Sequence
  source: /note="Description of Artificial Sequence: Synthetic oligonucleotide"
uccuuaccucaucccauauuu

SEQ ID NO: 1005 - RNA, 21 nt, Artificial Sequence
  source: /note="Description of Artificial Sequence: Synthetic oligonucleotide"
uucacagaggucugacaucau

SEQ ID NO: 1006 - RNA, 21 nt, Artificial Sequence
  source: /note="Description of Artificial Sequence: Synthetic oligonucleotide"
uugggaaaaacugguaucaaa

SEQ ID NO: 1007 - skipped

SEQ ID NO: 1008 - RNA, 21 nt, Artificial Sequence
  source: /note="Description of Artificial Sequence: Synthetic oligonucleotide"
ugguaucaaaaccucaugucu

SEQ ID NO: 1009 - RNA, 21 nt, Artificial Sequence
  source: /note="Description of Artificial Sequence: Synthetic oligonucleotide"
cucugcccaguuuuugugaau

SEQ ID NO: 1010 - RNA, 21 nt, Artificial Sequence
  source: /note="Description of Artificial Sequence: Synthetic oligonucleotide"
uuuuugugaauacuggguuca

SEQ ID NO: 1011-1012 - skipped (2 entries)

SEQ ID NO: 1013 - RNA, 21 nt, Artificial Sequence
  source: /note="Description of Artificial Sequence: Synthetic oligonucleotide"
ugaauacuggguucaccaaaa

SEQ ID NO: 1014 - RNA, 21 nt, Artificial Sequence
  source: /note="Description of Artificial Sequence: Synthetic oligonucleotide"
gaauacuggguucaccaaaaa

SEQ ID NO: 1015 - skipped

SEQ ID NO: 1016 - RNA, 21 nt, Artificial Sequence
  source: /note="Description of Artificial Sequence: Synthetic oligonucleotide"
aaaaauccaagcacaagauua

SEQ ID NO: 1017 - RNA, 21 nt, Artificial Sequence
  source: /note="Description of Artificial Sequence: Synthetic oligonucleotide"
aaaauccaagcacaagauuau

SEQ ID NO: 1018-1020 - skipped (3 entries)

SEQ ID NO: 1021 - RNA, 21 nt, Artificial Sequence
  source: /note="Description of Artificial Sequence: Synthetic oligonucleotide"
aagauuauggccuguauugga

SEQ ID NO: 1022 - RNA, 21 nt, Artificial Sequence
  source: /note="Description of Artificial Sequence: Synthetic oligonucleotide"
gauuauggccuguauuggaga

SEQ ID NO: 1023-1024 - skipped (2 entries)

SEQ ID NO: 1025 - RNA, 21 nt, Artificial Sequence
  source: /note="Description of Artificial Sequence: Synthetic oligonucleotide"
gccuguauuggagacagauga

SEQ ID NO: 1026 - RNA, 21 nt, Artificial Sequence
  source: /note="Description of Artificial Sequence: Synthetic oligonucleotide"
cugguaucaaaaccucauguu

SEQ ID NO: 1027 - RNA, 21 nt, Artificial Sequence
  source: /note="Description of Artificial Sequence: Synthetic oligonucleotide"
gguaucaaaaccucaugucuu

SEQ ID NO: 1028 - RNA, 21 nt, Artificial Sequence
  source: /note="Description of Artificial Sequence: Synthetic oligonucleotide"
ucaaaaccucaugucucugcu

SEQ ID NO: 1029 - RNA, 21 nt, Artificial Sequence
  source: /note="Description of Artificial Sequence: Synthetic oligonucleotide"
cccaguuuuugugaauacugu

SEQ ID NO: 1030 - RNA, 21 nt, Artificial Sequence
  source: /note="Description of Artificial Sequence: Synthetic oligonucleotide"
uuuugugaauacuggguucau

SEQ ID NO: 1031 - RNA, 21 nt, Artificial Sequence
  source: /note="Description of Artificial Sequence: Synthetic oligonucleotide"
uuugugaauacuggguucacu

SEQ ID NO: 1032 - RNA, 21 nt, Artificial Sequence
  source: /note="Description of Artificial Sequence: Synthetic oligonucleotide"
auacuggguucaccaaaaauu

SEQ ID NO: 1033 - RNA, 21 nt, Artificial Sequence
  source: /note="Description of Artificial Sequence: Synthetic oligonucleotide"
uacuggguucaccaaaaaucu

SEQ ID NO: 1034 - RNA, 21 nt, Artificial Sequence
  source: /note="Description of Artificial Sequence: Synthetic oligonucleotide"
caccaaaaauccaagcacaau

SEQ ID NO: 1035 - RNA, 21 nt, Artificial Sequence
  source: /note="Description of Artificial Sequence: Synthetic oligonucleotide"
aaauccaagcacaagauuauu

SEQ ID NO: 1036 - RNA, 21 nt, Artificial Sequence
  source: /note="Description of Artificial Sequence: Synthetic oligonucleotide"
aauccaagcacaagauuaugu

SEQ ID NO: 1037 - RNA, 21 nt, Artificial Sequence
  source: /note="Description of Artificial Sequence: Synthetic oligonucleotide"
auccaagcacaagauuauggu

SEQ ID NO: 1038 - RNA, 21 nt, Artificial Sequence
  source: /note="Description of Artificial Sequence: Synthetic oligonucleotide"
uccaagcacaagauuauggcu

SEQ ID NO: 1039 - RNA, 21 nt, Artificial Sequence
  source: /note="Description of Artificial Sequence: Synthetic oligonucleotide"
acaagauuauggccuguauuu

SEQ ID NO: 1040 - RNA, 21 nt, Artificial Sequence
  source: /note="Description of Artificial Sequence: Synthetic oligonucleotide"
caagauuauggccuguauugu

SEQ ID NO: 1041 - RNA, 21 nt, Artificial Sequence
  source: /note="Description of Artificial Sequence: Synthetic oligonucleotide"
auuauggccuguauuggagau

SEQ ID NO: 1042 - RNA, 21 nt, Artificial Sequence
  source: /note="Description of Artificial Sequence: Synthetic oligonucleotide"
ggccuguauuggagacagauu

SEQ ID NO: 1043 - RNA, 21 nt, Artificial Sequence
  source: /note="Description of Artificial Sequence: Synthetic oligonucleotide"
guaagaagucugauagaugga

SEQ ID NO: 1044 - skipped

SEQ ID NO: 1045 - RNA, 21 nt, Artificial Sequence
  source: /note="Description of Artificial Sequence: Synthetic oligonucleotide"
aagaagucugauagauggaau

SEQ ID NO: 1046 - RNA, 21 nt, Artificial Sequence
  source: /note="Description of Artificial Sequence: Synthetic oligonucleotide"
agaagucugauagauggaaua

SEQ ID NO: 1047 - skipped

SEQ ID NO: 1048 - RNA, 21 nt, Artificial Sequence
  source: /note="Description of Artificial Sequence: Synthetic oligonucleotide"
agauggaauacuuaccaauaa

SEQ ID NO: 1049 - RNA, 21 nt, Artificial Sequence
  source: /note="Description of Artificial Sequence: Synthetic oligonucleotide"
auggaauacuuaccaauaaga

SEQ ID NO: 1050 - RNA, 21 nt, Artificial Sequence
  source: /note="Description of Artificial Sequence: Synthetic oligonucleotide"
uggaauacuuaccaauaagaa

SEQ ID NO: 1051 - RNA, 21 nt, Artificial Sequence
  source: /note="Description of Artificial Sequence: Synthetic oligonucleotide"
ggaauacuuaccaauaagaaa

SEQ ID NO: 1052 - RNA, 21 nt, Artificial Sequence
  source: /note="Description of Artificial Sequence: Synthetic oligonucleotide"
gaauacuuaccaauaagaaaa

SEQ ID NO: 1053 - RNA, 21 nt, Artificial Sequence
  source: /note="Description of Artificial Sequence: Synthetic oligonucleotide"
aauacuuaccaauaagaaaau

SEQ ID NO: 1054 - RNA, 21 nt, Artificial Sequence
  source: /note="Description of Artificial Sequence: Synthetic oligonucleotide"
uuucuuccugaacgcgccuca

SEQ ID NO: 1055-1056 - skipped (2 entries)

SEQ ID NO: 1057 - RNA, 21 nt, Artificial Sequence
  source: /note="Description of Artificial Sequence: Synthetic oligonucleotide"
aaaucguaugcagaauauuca

SEQ ID NO: 1058 - RNA, 21 nt, Artificial Sequence
  source: /note="Description of Artificial Sequence: Synthetic oligonucleotide"
aucguaugcagaauauucaau

SEQ ID NO: 1059 - RNA, 21 nt, Artificial Sequence
  source: /note="Description of Artificial Sequence: Synthetic oligonucleotide"
ucguaugcagaauauucaauu

SEQ ID NO: 1060 - RNA, 21 nt, Artificial Sequence
  source: /note="Description of Artificial Sequence: Synthetic oligonucleotide"
cguaugcagaauauucaauuu

SEQ ID NO: 1061 - RNA, 21 nt, Artificial Sequence
  source: /note="Description of Artificial Sequence: Synthetic oligonucleotide"
augcagaauauucaauuugaa

SEQ ID NO: 1062 - RNA, 21 nt, Artificial Sequence
  source: /note="Description of Artificial Sequence: Synthetic oligonucleotide"
gaagucugauagauggaauau

SEQ ID NO: 1063 - RNA, 21 nt, Artificial Sequence
  source: /note="Description of Artificial Sequence: Synthetic oligonucleotide"
ucugauagauggaauacuuau

SEQ ID NO: 1064 - RNA, 21 nt, Artificial Sequence
  source: /note="Description of Artificial Sequence: Synthetic oligonucleotide"
gauggaauacuuaccaauaau

SEQ ID NO: 1065 - RNA, 21 nt, Artificial Sequence
  source: /note="Description of Artificial Sequence: Synthetic oligonucleotide"
acagaaguuucuuccugaacu

SEQ ID NO: 1066 - RNA, 21 nt, Artificial Sequence
  source: /note="Description of Artificial Sequence: Synthetic oligonucleotide"
agaaguuucuuccugaacgcu

SEQ ID NO: 1067 - RNA, 21 nt, Artificial Sequence
  source: /note="Description of Artificial Sequence: Synthetic oligonucleotide"
aaguuucuuccugaacgcgcu

SEQ ID NO: 1068 - RNA, 21 nt, Artificial Sequence
  source: /note="Description of Artificial Sequence: Synthetic oligonucleotide"
guuucuuccugaacgcgccuu

SEQ ID NO: 1069 - RNA, 21 nt, Artificial Sequence
  source: /note="Description of Artificial Sequence: Synthetic oligonucleotide"
ucuuccugaacgcgccucagu

SEQ ID NO: 1070 - RNA, 21 nt, Artificial Sequence
  source: /note="Description of Artificial Sequence: Synthetic oligonucleotide"
gcagaauauucaauuugaagu

SEQ ID NO: 1071 - RNA, 21 nt, Artificial Sequence
  source: /note="Description of Artificial Sequence: Synthetic oligonucleotide"
aauauucaauuugaagcaguu

SEQ ID NO: 1072 - skipped

SEQ ID NO: 1073 - RNA, 21 nt, Artificial Sequence
  source: /note="Description of Artificial Sequence: Synthetic oligonucleotide"
gauguaugcaugauaaugaua

SEQ ID NO: 1074 - RNA, 21 nt, Artificial Sequence
  source: /note="Description of Artificial Sequence: Synthetic oligonucleotide"
caaugcugcaaagcuuuauuu

SEQ ID NO: 1075 - RNA, 21 nt, Artificial Sequence
  source: /note="Description of Artificial Sequence: Synthetic oligonucleotide"
aaagcuuuauuucacauuuuu

SEQ ID NO: 1076 - RNA, 21 nt, Artificial Sequence
  source: /note="Description of Artificial Sequence: Synthetic oligonucleotide"
aauuugaagcagugguuggcu

SEQ ID NO: 1077 - RNA, 21 nt, Artificial Sequence
  source: /note="Description of Artificial Sequence: Synthetic oligonucleotide"
aaugcugcaaagcuuuauuuc

SEQ ID NO: 1078 - RNA, 21 nt, Artificial Sequence
  source: /note="Description of Artificial Sequence: Synthetic oligonucleotide"
ugcugcaaagcuuuauuucau

SEQ ID NO: 1079 - skipped

SEQ ID NO: 1080 - RNA, 21 nt, Artificial Sequence
  source: /note="Description of Artificial Sequence: Synthetic oligonucleotide"
agauuaauuaccugucuuccu

SEQ ID NO: 1081 - RNA, 21 nt, Artificial Sequence
  source: /note="Description of Artificial Sequence: Synthetic oligonucleotide"
auuaauuaccugucuuccugu

SEQ ID NO: 1082 - RNA, 21 nt, Artificial Sequence
  source: /note="Description of Artificial Sequence: Synthetic oligonucleotide"
uaauuaccugucuuccuguuu

SEQ ID NO: 1083 - RNA, 21 nt, Artificial Sequence
  source: /note="Description of Artificial Sequence: Synthetic oligonucleotide"
uaccugucuuccuguuucuca

SEQ ID NO: 1084 - RNA, 21 nt, Artificial Sequence
  source: /note="Description of Artificial Sequence: Synthetic oligonucleotide"
accugucuuccuguuucucaa

SEQ ID NO: 1085 - RNA, 21 nt, Artificial Sequence
  source: /note="Description of Artificial Sequence: Synthetic oligonucleotide"
ucuuccuguuucucaagaaua

SEQ ID NO: 1086 - RNA, 21 nt, Artificial Sequence
  source: /note="Description of Artificial Sequence: Synthetic oligonucleotide"
uuuuccuuucaugccucuuaa

SEQ ID NO: 1087 - RNA, 21 nt, Artificial Sequence
  source: /note="Description of Artificial Sequence: Synthetic oligonucleotide"
uccuuucaugccucuuaaaaa

SEQ ID NO: 1088 - RNA, 21 nt, Artificial Sequence
  source: /note="Description of Artificial Sequence: Synthetic oligonucleotide"
cuuucaugccucuuaaaaacu

SEQ ID NO: 1089 - RNA, 21 nt, Artificial Sequence
  source: /note="Description of Artificial Sequence: Synthetic oligonucleotide"
aaaacauugguuuggcacuau

SEQ ID NO: 1090 - RNA, 21 nt, Artificial Sequence
  source: /note="Description of Artificial Sequence: Synthetic oligonucleotide"
gauuaauuaccugucuuccuu

SEQ ID NO: 1091 - RNA, 21 nt, Artificial Sequence
  source: /note="Description of Artificial Sequence: Synthetic oligonucleotide"
uuaccugucuuccuguuucuu

SEQ ID NO: 1092 - RNA, 21 nt, Artificial Sequence
  source: /note="Description of Artificial Sequence: Synthetic oligonucleotide"
ccugucuuccuguuucucaau

SEQ ID NO: 1093 - RNA, 21 nt, Artificial Sequence
  source: /note="Description of Artificial Sequence: Synthetic oligonucleotide"
ggucuguuuuuccuuucaugu

SEQ ID NO: 1094 - RNA, 21 nt, Artificial Sequence
  source: /note="Description of Artificial Sequence: Synthetic oligonucleotide"
gucuguuuuuccuuucaugcu

SEQ ID NO: 1095 - RNA, 21 nt, Artificial Sequence
  source: /note="Description of Artificial Sequence: Synthetic oligonucleotide"
uuauuuacacagggaagguuu

SEQ ID NO: 1096 - RNA, 21 nt, Artificial Sequence
  source: /note="Description of Artificial Sequence: Synthetic oligonucleotide"
uauuuacacagggaagguuua

SEQ ID NO: 1097-1098 - skipped (2 entries)

SEQ ID NO: 1099 - RNA, 21 nt, Artificial Sequence
  source: /note="Description of Artificial Sequence: Synthetic oligonucleotide"
gggaagguuuaagacuguuca

SEQ ID NO: 1100 - RNA, 21 nt, Artificial Sequence
  source: /note="Description of Artificial Sequence: Synthetic oligonucleotide"
ggaagguuuaagacuguucaa

SEQ ID NO: 1101 - skipped

SEQ ID NO: 1102 - RNA, 21 nt, Artificial Sequence
  source: /note="Description of Artificial Sequence: Synthetic oligonucleotide"
uuuaagacuguucaaguagca

SEQ ID NO: 1103 - skipped

SEQ ID NO: 1104 - RNA, 21 nt, Artificial Sequence
  source: /note="Description of Artificial Sequence: Synthetic oligonucleotide"
gacuguucaaguagcauucca

SEQ ID NO: 1105 - RNA, 21 nt, Artificial Sequence
  source: /note="Description of Artificial Sequence: Synthetic oligonucleotide"
acuguucaaguagcauuccaa

SEQ ID NO: 1106-1107 - skipped (2 entries)

SEQ ID NO: 1108 - RNA, 21 nt, Artificial Sequence
  source: /note="Description of Artificial Sequence: Synthetic oligonucleotide"
caaguagcauuccaaucugua

SEQ ID NO: 1109-1110 - skipped (2 entries)

SEQ ID NO: 1111 - RNA, 21 nt, Artificial Sequence
  source: /note="Description of Artificial Sequence: Synthetic oligonucleotide"
aacuuauuuacacagggaagu

SEQ ID NO: 1112 - RNA, 21 nt, Artificial Sequence
  source: /note="Description of Artificial Sequence: Synthetic oligonucleotide"
uacacagggaagguuuaagau

SEQ ID NO: 1113 - RNA, 21 nt, Artificial Sequence
  source: /note="Description of Artificial Sequence: Synthetic oligonucleotide"
cacagggaagguuuaagacuu

SEQ ID NO: 1114 - RNA, 21 nt, Artificial Sequence
  source: /note="Description of Artificial Sequence: Synthetic oligonucleotide"
agggaagguuuaagacuguuu

SEQ ID NO: 1115 - RNA, 21 nt, Artificial Sequence
  source: /note="Description of Artificial Sequence: Synthetic oligonucleotide"
gaagguuuaagacuguucaau

SEQ ID NO: 1116 - RNA, 21 nt, Artificial Sequence
  source: /note="Description of Artificial Sequence: Synthetic oligonucleotide"
gguuuaagacuguucaaguau

SEQ ID NO: 1117 - RNA, 21 nt, Artificial Sequence
  source: /note="Description of Artificial Sequence: Synthetic oligonucleotide"
aagacuguucaaguagcauuu

SEQ ID NO: 1118 - RNA, 21 nt, Artificial Sequence
  source: /note="Description of Artificial Sequence: Synthetic oligonucleotide"
agacuguucaaguagcauucu

SEQ ID NO: 1119 - RNA, 21 nt, Artificial Sequence
  source: /note="Description of Artificial Sequence: Synthetic oligonucleotide"
uguucaaguagcauuccaauu

SEQ ID NO: 1120 - RNA, 21 nt, Artificial Sequence
  source: /note="Description of Artificial Sequence: Synthetic oligonucleotide"
uucaaguagcauuccaaucuu

SEQ ID NO: 1121 - RNA, 21 nt, Artificial Sequence
  source: /note="Description of Artificial Sequence: Synthetic oligonucleotide"
gcagcuuuaucucaaccugga

SEQ ID NO: 1122 - RNA, 21 nt, Artificial Sequence
  source: /note="Description of Artificial Sequence: Synthetic oligonucleotide"
agcauuugaaagauuucccua

SEQ ID NO: 1123 - RNA, 21 nt, Artificial Sequence
  source: /note="Description of Artificial Sequence: Synthetic oligonucleotide"
ugaaagauuucccuagccucu

SEQ ID NO: 1124 - skipped

SEQ ID NO: 1125 - RNA, 21 nt, Artificial Sequence
  source: /note="Description of Artificial Sequence: Synthetic oligonucleotide"
uucccuagccucuuccuuuuu

SEQ ID NO: 1126 - RNA, 21 nt, Artificial Sequence
  source: /note="Description of Artificial Sequence: Synthetic oligonucleotide"
aagaacacagaaugagugcau

SEQ ID NO: 1127 - RNA, 21 nt, Artificial Sequence
  source: /note="Description of Artificial Sequence: Synthetic oligonucleotide"
gaacacagaaugagugcacau

SEQ ID NO: 1128 - RNA, 21 nt, Artificial Sequence
  source: /note="Description of Artificial Sequence: Synthetic oligonucleotide"
aacacagaaugagugcacagu

SEQ ID NO: 1129 - RNA, 21 nt, Artificial Sequence
  source: /note="Description of Artificial Sequence: Synthetic oligonucleotide"
cagaaugagugcacagcuaau

SEQ ID NO: 1130 - RNA, 21 nt, Artificial Sequence
  source: /note="Description of Artificial Sequence: Synthetic oligonucleotide"
gaaugagugcacagcuaagau

SEQ ID NO: 1131 - RNA, 21 nt, Artificial Sequence
  source: /note="Description of Artificial Sequence: Synthetic oligonucleotide"
uucagcauuugaaagauuucu

SEQ ID NO: 1132 - RNA, 21 nt, Artificial Sequence
  source: /note="Description of Artificial Sequence: Synthetic oligonucleotide"
cauuugaaagauuucccuagu

SEQ ID NO: 1133 - RNA, 21 nt, Artificial Sequence
  source: /note="Description of Artificial Sequence: Synthetic oligonucleotide"
auuugaaagauuucccuagcu

SEQ ID NO: 1134-1135 - skipped (2 entries)

SEQ ID NO: 1136 - RNA, 21 nt, Artificial Sequence
  source: /note="Description of Artificial Sequence: Synthetic oligonucleotide"
gugcaacucuauucuggacuu

SEQ ID NO: 1137 - skipped

SEQ ID NO: 1138 - RNA, 21 nt, Artificial Sequence
  source: /note="Description of Artificial Sequence: Synthetic oligonucleotide"
gcaacucuauucuggacuuua

SEQ ID NO: 1139 - RNA, 21 nt, Artificial Sequence
  source: /note="Description of Artificial Sequence: Synthetic oligonucleotide"
caacucuauucuggacuuuau

SEQ ID NO: 1140-1141 - skipped (2 entries)

SEQ ID NO: 1142 - RNA, 21 nt, Artificial Sequence
  source: /note="Description of Artificial Sequence: Synthetic oligonucleotide"
aguccaccaaaaguggacccu

SEQ ID NO: 1143-1147 - skipped (5 entries)

SEQ ID NO: 1148 - RNA, 21 nt, Artificial Sequence
  source: /note="Description of Artificial Sequence: Synthetic oligonucleotide"
aaacggugcaacucuauucuu

SEQ ID NO: 1149 - RNA, 21 nt, Artificial Sequence
  source: /note="Description of Artificial Sequence: Synthetic oligonucleotide"
aacggugcaacucuauucugu

SEQ ID NO: 1150 - RNA, 21 nt, Artificial Sequence
  source: /note="Description of Artificial Sequence: Synthetic oligonucleotide"
uauucuggacuuuauuacuuu

SEQ ID NO: 1151 - RNA, 21 nt, Artificial Sequence
  source: /note="Description of Artificial Sequence: Synthetic oligonucleotide"
aaaguggacccucuauauuuc

SEQ ID NO: 1152 - RNA, 21 nt, Artificial Sequence
  source: /note="Description of Artificial Sequence: Synthetic oligonucleotide"
aaguggacccucuauauuucu

SEQ ID NO: 1153 - RNA, 21 nt, Artificial Sequence
  source: /note="Description of Artificial Sequence: Synthetic oligonucleotide"
auguuuagacaauuuuaggcu

SEQ ID NO: 1154 - RNA, 21 nt, Artificial Sequence
  source: /note="Description of Artificial Sequence: Synthetic oligonucleotide"
guuuagacaauuuuaggcuca

SEQ ID NO: 1155-1158 - skipped (4 entries)

SEQ ID NO: 1159 - RNA, 21 nt, Artificial Sequence
  source: /note="Description of Artificial Sequence: Synthetic oligonucleotide"
gacaauuuuaggcucaaaaau

SEQ ID NO: 1160 - skipped

SEQ ID NO: 1161 - RNA, 21 nt, Artificial Sequence
  source: /note="Description of Artificial Sequence: Synthetic oligonucleotide"
uaggcucaaaaauuaaagcua

SEQ ID NO: 1162 - RNA, 21 nt, Artificial Sequence
  source: /note="Description of Artificial Sequence: Synthetic oligonucleotide"
aggcucaaaaauuaaagcuaa

SEQ ID NO: 1163 - RNA, 21 nt, Artificial Sequence
  source: /note="Description of Artificial Sequence: Synthetic oligonucleotide"
gcucaaaaauuaaagcuaaca

SEQ ID NO: 1164 - RNA, 21 nt, Artificial Sequence
  source: /note="Description of Artificial Sequence: Synthetic oligonucleotide"
ucaaaaauuaaagcuaacaca

SEQ ID NO: 1165 - RNA, 21 nt, Artificial Sequence
  source: /note="Description of Artificial Sequence: Synthetic oligonucleotide"
uucauauauccuuggucccau

SEQ ID NO: 1166 - RNA, 21 nt, Artificial Sequence
  source: /note="Description of Artificial Sequence: Synthetic oligonucleotide"
gauguuuagacaauuuuaggu

SEQ ID NO: 1167 - RNA, 21 nt, Artificial Sequence
  source: /note="Description of Artificial Sequence: Synthetic oligonucleotide"
ggcucaaaaauuaaagcuaau

SEQ ID NO: 1168 - RNA, 21 nt, Artificial Sequence
  source: /note="Description of Artificial Sequence: Synthetic oligonucleotide"
cucaaaaauuaaagcuaacau

SEQ ID NO: 1169 - RNA, 21 nt, Artificial Sequence
  source: /note="Description of Artificial Sequence: Synthetic oligonucleotide"
caaaaauuaaagcuaacacau

SEQ ID NO: 1170 - RNA, 21 nt, Artificial Sequence
  source: /note="Description of Artificial Sequence: Synthetic oligonucleotide"
aaauuaaagcuaacacaggaa

SEQ ID NO: 1171 - RNA, 21 nt, Artificial Sequence
  source: /note="Description of Artificial Sequence: Synthetic oligonucleotide"
uaacacaggaaaaggaacugu

SEQ ID NO: 1172 - RNA, 21 nt, Artificial Sequence
  source: /note="Description of Artificial Sequence: Synthetic oligonucleotide"
ggaaaaggaacuguacuggcu

SEQ ID NO: 1173-1174 - skipped (2 entries)

SEQ ID NO: 1175 - RNA, 21 nt, Artificial Sequence
  source: /note="Description of Artificial Sequence: Synthetic oligonucleotide"
caggaaaaggaacuguacugu

SEQ ID NO: 1176 - RNA, 21 nt, Artificial Sequence
  source: /note="Description of Artificial Sequence: Synthetic oligonucleotide"
aggaacuguacuggcuauuau

SEQ ID NO: 1177 - RNA, 21 nt, Artificial Sequence
  source: /note="Description of Artificial Sequence: Synthetic oligonucleotide"
cucccacuacaucaagacuaa

SEQ ID NO: 1178-1179 - skipped (2 entries)

SEQ ID NO: 1180 - RNA, 21 nt, Artificial Sequence
  source: /note="Description of Artificial Sequence: Synthetic oligonucleotide"
cacuacaucaagacuaaucuu

SEQ ID NO: 1181 - RNA, 21 nt, Artificial Sequence
  source: /note="Description of Artificial Sequence: Synthetic oligonucleotide"
cuacaucaagacuaaucuugu

SEQ ID NO: 1182-1183 - skipped (2 entries)

SEQ ID NO: 1184 - RNA, 21 nt, Artificial Sequence
  source: /note="Description of Artificial Sequence: Synthetic oligonucleotide"
guguuuuucacauguauuaua

SEQ ID NO: 1185 - RNA, 21 nt, Artificial Sequence
  source: /note="Description of Artificial Sequence: Synthetic oligonucleotide"
ucacauguauuauagaaugcu

SEQ ID NO: 1186 - RNA, 21 nt, Artificial Sequence
  source: /note="Description of Artificial Sequence: Synthetic oligonucleotide"
cacauguauuauagaaugcuu

SEQ ID NO: 1187-1191 - skipped (5 entries)

SEQ ID NO: 1192 - RNA, 21 nt, Artificial Sequence
  source: /note="Description of Artificial Sequence: Synthetic oligonucleotide"
cuuuugcauggacuauccucu

SEQ ID NO: 1193 - RNA, 21 nt, Artificial Sequence
  source: /note="Description of Artificial Sequence: Synthetic oligonucleotide"
uugcauggacuauccucuugu

SEQ ID NO: 1194-1195 - skipped (2 entries)

SEQ ID NO: 1196 - RNA, 21 nt, Artificial Sequence
  source: /note="Description of Artificial Sequence: Synthetic oligonucleotide"
ggacuauccucuuguuuuuau

SEQ ID NO: 1197 - RNA, 21 nt, Artificial Sequence
  source: /note="Description of Artificial Sequence: Synthetic oligonucleotide"
gacuauccucuuguuuuuauu

SEQ ID NO: 1198 - RNA, 21 nt, Artificial Sequence
  source: /note="Description of Artificial Sequence: Synthetic oligonucleotide"
cuauccucuuguuuuuauuaa

SEQ ID NO: 1199 - RNA, 21 nt, Artificial Sequence
  source: /note="Description of Artificial Sequence: Synthetic oligonucleotide"
cccacuacaucaagacuaauu

SEQ ID NO: 1200 - RNA, 21 nt, Artificial Sequence
  source: /note="Description of Artificial Sequence: Synthetic oligonucleotide"
acuacaucaagacuaaucuuu

SEQ ID NO: 1201 - RNA, 21 nt, Artificial Sequence
  source: /note="Description of Artificial Sequence: Synthetic oligonucleotide"
augcuuuugcauggacuaucu

SEQ ID NO: 1202 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagucctagggaggagguacugu

SEQ ID NO: 1203 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggugatcagaagcagaaggauu

SEQ ID NO: 1204 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaagtaggaguagaugauggu

SEQ ID NO: 1205 - skipped

SEQ ID NO: 1206 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgactccaaguaggaguagau

SEQ ID NO: 1207 - RNA, 23 nt, Artificial Sequence
  source: /note="Description of Artificial Sequence: Synthetic oligonucleotide"
auaguccuagggaggagguacug

SEQ ID NO: 1208 - RNA, 23 nt, Artificial Sequence
  source: /note="Description of Artificial Sequence: Synthetic oligonucleotide"
auucugguucaguccuuguguag

SEQ ID NO: 1209 - RNA, 23 nt, Artificial Sequence
  source: /note="Description of Artificial Sequence: Synthetic oligonucleotide"
aaaguaggaguagaugaugguga

SEQ ID NO: 1210 - RNA, 23 nt, Artificial Sequence
  source: /note="Description of Artificial Sequence: Synthetic oligonucleotide"
acaaguaggaguagaugauggug

SEQ ID NO: 1211 - RNA, 23 nt, Artificial Sequence
  source: /note="Description of Artificial Sequence: Synthetic oligonucleotide"
auccaaguaggaguagaugaugg

SEQ ID NO: 1212 - RNA, 23 nt, Artificial Sequence
  source: /note="Description of Artificial Sequence: Synthetic oligonucleotide"
aacuccaaguaggaguagaugau

SEQ ID NO: 1213 - RNA, 23 nt, Artificial Sequence
  source: /note="Description of Artificial Sequence: Synthetic oligonucleotide"
aaacgacuccaaguaggaguaga

SEQ ID NO: 1214 - RNA, 23 nt, Artificial Sequence
  source: /note="Description of Artificial Sequence: Synthetic oligonucleotide"
acaacgacuccaaguaggaguag

SEQ ID NO: 1215 - skipped

SEQ ID NO: 1216 - RNA, 23 nt, Artificial Sequence
  source: /note="Description of Artificial Sequence: Synthetic oligonucleotide"
aaccaacgacuccaaguaggagu

SEQ ID NO: 1217-1219 - skipped (3 entries)

SEQ ID NO: 1220 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguuutcggcacucagcugcag

SEQ ID NO: 1221-1222 - skipped (2 entries)

SEQ ID NO: 1223 - RNA, 23 nt, Artificial Sequence
  source: /note="Description of Artificial Sequence: Synthetic oligonucleotide"
acgcuuauuaauaucccacagaa

SEQ ID NO: 1224 - RNA, 23 nt, Artificial Sequence
  source: /note="Description of Artificial Sequence: Synthetic oligonucleotide"
auuuucggcacucagcugcaguu

SEQ ID NO: 1225 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaguutucggcacucagcugca

SEQ ID NO: 1226 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuagutuucggcacucagcugc

SEQ ID NO: 1227 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accuagtuuucggcacucagcug

SEQ ID NO: 1228 - RNA, 23 nt, Artificial Sequence
  source: /note="Description of Artificial Sequence: Synthetic oligonucleotide"
agccuaguuuucggcacucagcu

SEQ ID NO: 1229 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgcctaguuuucggcacucag

SEQ ID NO: 1230 - RNA, 23 nt, Artificial Sequence
  source: /note="Description of Artificial Sequence: Synthetic oligonucleotide"
augacgccuaguuuucggcacuc

SEQ ID NO: 1231 - RNA, 23 nt, Artificial Sequence
  source: /note="Description of Artificial Sequence: Synthetic oligonucleotide"
aagugacgccuaguuuucggcac

SEQ ID NO: 1232 - RNA, 23 nt, Artificial Sequence
  source: /note="Description of Artificial Sequence: Synthetic oligonucleotide"
acagugacgccuaguuuucggca

SEQ ID NO: 1233 - RNA, 23 nt, Artificial Sequence
  source: /note="Description of Artificial Sequence: Synthetic oligonucleotide"
acaugcgcagugacgccuaguuu

SEQ ID NO: 1234 - skipped

SEQ ID NO: 1235 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accugatuuagagagcgauagau

SEQ ID NO: 1236 - skipped

SEQ ID NO: 1237 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacctgauuuagagagcgaua

SEQ ID NO: 1238 - RNA, 23 nt, Artificial Sequence
  source: /note="Description of Artificial Sequence: Synthetic oligonucleotide"
uuucuucaccugauuuagagagc

SEQ ID NO: 1239 - RNA, 23 nt, Artificial Sequence
  source: /note="Description of Artificial Sequence: Synthetic oligonucleotide"
ugucccagcauuauucaccacga

SEQ ID NO: 1240 - RNA, 23 nt, Artificial Sequence
  source: /note="Description of Artificial Sequence: Synthetic oligonucleotide"
uauacugucccagcauuauucac

SEQ ID NO: 1241 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auauactgucccagcauuauuca

SEQ ID NO: 1242 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucggctggauauacugucccag

SEQ ID NO: 1243 - RNA, 23 nt, Artificial Sequence
  source: /note="Description of Artificial Sequence: Synthetic oligonucleotide"
agaucggcuggauauacuguccc

SEQ ID NO: 1244 - RNA, 23 nt, Artificial Sequence
  source: /note="Description of Artificial Sequence: Synthetic oligonucleotide"
aagaucggcuggauauacugucc

SEQ ID NO: 1245 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaagatcggcuggauauacugu

SEQ ID NO: 1246 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augauutagagagcgauagaucu

SEQ ID NO: 1247 - RNA, 23 nt, Artificial Sequence
  source: /note="Description of Artificial Sequence: Synthetic oligonucleotide"
aaccugauuuagagagcgauaga

SEQ ID NO: 1248 - RNA, 23 nt, Artificial Sequence
  source: /note="Description of Artificial Sequence: Synthetic oligonucleotide"
auucaccugauuuagagagcgau

SEQ ID NO: 1249 - RNA, 23 nt, Artificial Sequence
  source: /note="Description of Artificial Sequence: Synthetic oligonucleotide"
aucccagcauuauucaccacgau

SEQ ID NO: 1250 - RNA, 23 nt, Artificial Sequence
  source: /note="Description of Artificial Sequence: Synthetic oligonucleotide"
augucccagcauuauucaccacg

SEQ ID NO: 1251 - RNA, 23 nt, Artificial Sequence
  source: /note="Description of Artificial Sequence: Synthetic oligonucleotide"
auggauauacugucccagcauua

SEQ ID NO: 1252 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuggatauacugucccagcauu

SEQ ID NO: 1253 - RNA, 23 nt, Artificial Sequence
  source: /note="Description of Artificial Sequence: Synthetic oligonucleotide"
agcuggauauacugucccagcau

SEQ ID NO: 1254 - RNA, 23 nt, Artificial Sequence
  source: /note="Description of Artificial Sequence: Synthetic oligonucleotide"
aggcuggauauacugucccagca

SEQ ID NO: 1255 - RNA, 23 nt, Artificial Sequence
  source: /note="Description of Artificial Sequence: Synthetic oligonucleotide"
aaucggcuggauauacuguccca

SEQ ID NO: 1256 - RNA, 23 nt, Artificial Sequence
  source: /note="Description of Artificial Sequence: Synthetic oligonucleotide"
aaagaucggcuggauauacuguc

SEQ ID NO: 1257 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguaatcucuucauccuuggug

SEQ ID NO: 1258 - skipped

SEQ ID NO: 1259 - RNA, 23 nt, Artificial Sequence
  source: /note="Description of Artificial Sequence: Synthetic oligonucleotide"
uccuaggauguugaccucaaaug

SEQ ID NO: 1260 - RNA, 23 nt, Artificial Sequence
  source: /note="Description of Artificial Sequence: Synthetic oligonucleotide"
uguccuaggauguugaccucaaa

SEQ ID NO: 1261 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augucctaggauguugaccucaa

SEQ ID NO: 1262 - skipped

SEQ ID NO: 1263 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaugtccuaggauguugaccu

SEQ ID NO: 1264 - RNA, 23 nt, Artificial Sequence
  source: /note="Description of Artificial Sequence: Synthetic oligonucleotide"
uccaaaaauguccuaggauguug

SEQ ID NO: 1265 - RNA, 23 nt, Artificial Sequence
  source: /note="Description of Artificial Sequence: Synthetic oligonucleotide"
auccaaaaauguccuaggauguu

SEQ ID NO: 1266 - skipped

SEQ ID NO: 1267 - RNA, 23 nt, Artificial Sequence
  source: /note="Description of Artificial Sequence: Synthetic oligonucleotide"
uuugugauccaaaaauguccuag

SEQ ID NO: 1268 - RNA, 23 nt, Artificial Sequence
  source: /note="Description of Artificial Sequence: Synthetic oligonucleotide"
uuuugugauccaaaaauguccua

SEQ ID NO: 1269 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugcutuugugauccaaaaaug

SEQ ID NO: 1270 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaagtgcuuuugugauccaaa

SEQ ID NO: 1271 - RNA, 23 nt, Artificial Sequence
  source: /note="Description of Artificial Sequence: Synthetic oligonucleotide"
ucgauggaagaagugcuuuugug

SEQ ID NO: 1272 - RNA, 23 nt, Artificial Sequence
  source: /note="Description of Artificial Sequence: Synthetic oligonucleotide"
aucgauggaagaagugcuuuugu

SEQ ID NO: 1273-1275 - skipped (3 entries)

SEQ ID NO: 1276 - RNA, 23 nt, Artificial Sequence
  source: /note="Description of Artificial Sequence: Synthetic oligonucleotide"
aguaaucucuucauccuuggugc

SEQ ID NO: 1277 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaugutgaccucaaaugucuug

SEQ ID NO: 1278 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaggatguugaccucaaauguc

SEQ ID NO: 1279 - RNA, 23 nt, Artificial Sequence
  source: /note="Description of Artificial Sequence: Synthetic oligonucleotide"
acuaggauguugaccucaaaugu

SEQ ID NO: 1280 - RNA, 23 nt, Artificial Sequence
  source: /note="Description of Artificial Sequence: Synthetic oligonucleotide"
auccuaggauguugaccucaaau

SEQ ID NO: 1281 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaaaatguccuaggauguugac

SEQ ID NO: 1282 - RNA, 23 nt, Artificial Sequence
  source: /note="Description of Artificial Sequence: Synthetic oligonucleotide"
acaaaaauguccuaggauguuga

SEQ ID NO: 1283 - RNA, 23 nt, Artificial Sequence
  source: /note="Description of Artificial Sequence: Synthetic oligonucleotide"
aauccaaaaauguccuaggaugu

SEQ ID NO: 1284 - RNA, 23 nt, Artificial Sequence
  source: /note="Description of Artificial Sequence: Synthetic oligonucleotide"
augauccaaaaauguccuaggau

SEQ ID NO: 1285 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuugtgauccaaaaauguccu

SEQ ID NO: 1286 - RNA, 23 nt, Artificial Sequence
  source: /note="Description of Artificial Sequence: Synthetic oligonucleotide"
aaagaagugcuuuugugauccaa

SEQ ID NO: 1287 - RNA, 23 nt, Artificial Sequence
  source: /note="Description of Artificial Sequence: Synthetic oligonucleotide"
aauggaagaagugcuuuugugau

SEQ ID NO: 1288 - RNA, 23 nt, Artificial Sequence
  source: /note="Description of Artificial Sequence: Synthetic oligonucleotide"
agauggaagaagugcuuuuguga

SEQ ID NO: 1289 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucgatggaagaagugcuuuug

SEQ ID NO: 1290 - RNA, 23 nt, Artificial Sequence
  source: /note="Description of Artificial Sequence: Synthetic oligonucleotide"
aaucaucgauggaagaagugcuu

SEQ ID NO: 1291 - RNA, 23 nt, Artificial Sequence
  source: /note="Description of Artificial Sequence: Synthetic oligonucleotide"
aacgauguggccaugauuucucu

SEQ ID NO: 1292 - RNA, 23 nt, Artificial Sequence
  source: /note="Description of Artificial Sequence: Synthetic oligonucleotide"
augacgauguggccaugauuucu

SEQ ID NO: 1293 - RNA, 23 nt, Artificial Sequence
  source: /note="Description of Artificial Sequence: Synthetic oligonucleotide"
aauaugggaugagguaaggaauc

SEQ ID NO: 1294 - RNA, 23 nt, Artificial Sequence
  source: /note="Description of Artificial Sequence: Synthetic oligonucleotide"
uggaacaauaugggaugagguaa

SEQ ID NO: 1295 - RNA, 23 nt, Artificial Sequence
  source: /note="Description of Artificial Sequence: Synthetic oligonucleotide"
ugcuggaacaauaugggaugagg

SEQ ID NO: 1296 - skipped

SEQ ID NO: 1297 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuugctggaacaauaugggaug

SEQ ID NO: 1298 - RNA, 23 nt, Artificial Sequence
  source: /note="Description of Artificial Sequence: Synthetic oligonucleotide"
aauuugcuggaacaauaugggau

SEQ ID NO: 1299 - RNA, 23 nt, Artificial Sequence
  source: /note="Description of Artificial Sequence: Synthetic oligonucleotide"
agaccucugugaaagccaacagc

SEQ ID NO: 1300 - RNA, 23 nt, Artificial Sequence
  source: /note="Description of Artificial Sequence: Synthetic oligonucleotide"
ugucagaccucugugaaagccaa

SEQ ID NO: 1301 - skipped

SEQ ID NO: 1302 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucugatgucagaccucugugaa

SEQ ID NO: 1303 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaagutcugaugucagaccucu

SEQ ID NO: 1304 - RNA, 23 nt, Artificial Sequence
  source: /note="Description of Artificial Sequence: Synthetic oligonucleotide"
aaauaugggaugagguaaggaau

SEQ ID NO: 1305 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augaugtcagaccucugugaaag

SEQ ID NO: 1306 - RNA, 23 nt, Artificial Sequence
  source: /note="Description of Artificial Sequence: Synthetic oligonucleotide"
uuugauaccaguuuuucccaagg

SEQ ID NO: 1307 - skipped

SEQ ID NO: 1308 - RNA, 23 nt, Artificial Sequence
  source: /note="Description of Artificial Sequence: Synthetic oligonucleotide"
agacaugagguuuugauaccagu

SEQ ID NO: 1309 - RNA, 23 nt, Artificial Sequence
  source: /note="Description of Artificial Sequence: Synthetic oligonucleotide"
auucacaaaaacugggcagagac

SEQ ID NO: 1310 - RNA, 23 nt, Artificial Sequence
  source: /note="Description of Artificial Sequence: Synthetic oligonucleotide"
ugaacccaguauucacaaaaacu

SEQ ID NO: 1311-1312 - skipped (2 entries)

SEQ ID NO: 1313 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuuggtgaacccaguauucaca

SEQ ID NO: 1314 - RNA, 23 nt, Artificial Sequence
  source: /note="Description of Artificial Sequence: Synthetic oligonucleotide"
uuuuuggugaacccaguauucac

SEQ ID NO: 1315 - skipped

SEQ ID NO: 1316 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucutgugcuuggauuuuugg

SEQ ID NO: 1317 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaauctugugcuuggauuuuug

SEQ ID NO: 1318-1320 - skipped (3 entries)

SEQ ID NO: 1321 - RNA, 23 nt, Artificial Sequence
  source: /note="Description of Artificial Sequence: Synthetic oligonucleotide"
uccaauacaggccauaaucuugu

SEQ ID NO: 1322 - RNA, 23 nt, Artificial Sequence
  source: /note="Description of Artificial Sequence: Synthetic oligonucleotide"
ucuccaauacaggccauaaucuu

SEQ ID NO: 1323-1324 - skipped (2 entries)

SEQ ID NO: 1325 - RNA, 23 nt, Artificial Sequence
  source: /note="Description of Artificial Sequence: Synthetic oligonucleotide"
ucaucugucuccaauacaggcca

SEQ ID NO: 1326 - RNA, 23 nt, Artificial Sequence
  source: /note="Description of Artificial Sequence: Synthetic oligonucleotide"
aacaugagguuuugauaccaguu

SEQ ID NO: 1327 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacatgagguuuugauaccag

SEQ ID NO: 1328 - RNA, 23 nt, Artificial Sequence
  source: /note="Description of Artificial Sequence: Synthetic oligonucleotide"
agcagagacaugagguuuugaua

SEQ ID NO: 1329 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaguatucacaaaaacugggca

SEQ ID NO: 1330 - RNA, 23 nt, Artificial Sequence
  source: /note="Description of Artificial Sequence: Synthetic oligonucleotide"
augaacccaguauucacaaaaac

SEQ ID NO: 1331 - RNA, 23 nt, Artificial Sequence
  source: /note="Description of Artificial Sequence: Synthetic oligonucleotide"
agugaacccaguauucacaaaaa

SEQ ID NO: 1332 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuuutggugaacccaguauuc

SEQ ID NO: 1333 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauuutuggugaacccaguauu

SEQ ID NO: 1334 - RNA, 23 nt, Artificial Sequence
  source: /note="Description of Artificial Sequence: Synthetic oligonucleotide"
auugugcuuggauuuuuggugaa

SEQ ID NO: 1335 - RNA, 23 nt, Artificial Sequence
  source: /note="Description of Artificial Sequence: Synthetic oligonucleotide"
aauaaucuugugcuuggauuuuu

SEQ ID NO: 1336 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaatcuugugcuuggauuuu

SEQ ID NO: 1337 - RNA, 23 nt, Artificial Sequence
  source: /note="Description of Artificial Sequence: Synthetic oligonucleotide"
accauaaucuugugcuuggauuu

SEQ ID NO: 1338 - RNA, 23 nt, Artificial Sequence
  source: /note="Description of Artificial Sequence: Synthetic oligonucleotide"
agccauaaucuugugcuuggauu

SEQ ID NO: 1339 - RNA, 23 nt, Artificial Sequence
  source: /note="Description of Artificial Sequence: Synthetic oligonucleotide"
aaauacaggccauaaucuugugc

SEQ ID NO: 1340 - RNA, 23 nt, Artificial Sequence
  source: /note="Description of Artificial Sequence: Synthetic oligonucleotide"
acaauacaggccauaaucuugug

SEQ ID NO: 1341 - RNA, 23 nt, Artificial Sequence
  source: /note="Description of Artificial Sequence: Synthetic oligonucleotide"
aucuccaauacaggccauaaucu

SEQ ID NO: 1342 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucugtcuccaauacaggccau

SEQ ID NO: 1343 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccauctaucagacuucuuacga

SEQ ID NO: 1344 - skipped

SEQ ID NO: 1345 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuccatcuaucagacuucuuac

SEQ ID NO: 1346 - RNA, 23 nt, Artificial Sequence
  source: /note="Description of Artificial Sequence: Synthetic oligonucleotide"
uauuccaucuaucagacuucuua

SEQ ID NO: 1347 - skipped

SEQ ID NO: 1348 - RNA, 23 nt, Artificial Sequence
  source: /note="Description of Artificial Sequence: Synthetic oligonucleotide"
uuauugguaaguauuccaucuau

SEQ ID NO: 1349 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuuautgguaaguauuccaucu

SEQ ID NO: 1350 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucuuatugguaaguauuccauc

SEQ ID NO: 1351 - RNA, 23 nt, Artificial Sequence
  source: /note="Description of Artificial Sequence: Synthetic oligonucleotide"
uuucuuauugguaaguauuccau

SEQ ID NO: 1352 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucutauugguaaguauucca

SEQ ID NO: 1353 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuuctuauugguaaguauucc

SEQ ID NO: 1354 - RNA, 23 nt, Artificial Sequence
  source: /note="Description of Artificial Sequence: Synthetic oligonucleotide"
ugaggcgcguucaggaagaaacu

SEQ ID NO: 1355-1356 - skipped (2 entries)

SEQ ID NO: 1357 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaauatucugcauacgauuuaa

SEQ ID NO: 1358 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugaatauucugcauacgauuu

SEQ ID NO: 1359 - RNA, 23 nt, Artificial Sequence
  source: /note="Description of Artificial Sequence: Synthetic oligonucleotide"
aauugaauauucugcauacgauu

SEQ ID NO: 1360 - RNA, 23 nt, Artificial Sequence
  source: /note="Description of Artificial Sequence: Synthetic oligonucleotide"
aaauugaauauucugcauacgau

SEQ ID NO: 1361 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucaaatugaauauucugcauac

SEQ ID NO: 1362 - RNA, 23 nt, Artificial Sequence
  source: /note="Description of Artificial Sequence: Synthetic oligonucleotide"
auauuccaucuaucagacuucuu

SEQ ID NO: 1363 - RNA, 23 nt, Artificial Sequence
  source: /note="Description of Artificial Sequence: Synthetic oligonucleotide"
auaaguauuccaucuaucagacu

SEQ ID NO: 1364 - RNA, 23 nt, Artificial Sequence
  source: /note="Description of Artificial Sequence: Synthetic oligonucleotide"
auuauugguaaguauuccaucua

SEQ ID NO: 1365 - RNA, 23 nt, Artificial Sequence
  source: /note="Description of Artificial Sequence: Synthetic oligonucleotide"
aguucaggaagaaacuucuguag

SEQ ID NO: 1366 - RNA, 23 nt, Artificial Sequence
  source: /note="Description of Artificial Sequence: Synthetic oligonucleotide"
agcguucaggaagaaacuucugu

SEQ ID NO: 1367 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcgcgtucaggaagaaacuucu

SEQ ID NO: 1368 - RNA, 23 nt, Artificial Sequence
  source: /note="Description of Artificial Sequence: Synthetic oligonucleotide"
aaggcgcguucaggaagaaacuu

SEQ ID NO: 1369 - RNA, 23 nt, Artificial Sequence
  source: /note="Description of Artificial Sequence: Synthetic oligonucleotide"
acugaggcgcguucaggaagaaa

SEQ ID NO: 1370 - RNA, 23 nt, Artificial Sequence
  source: /note="Description of Artificial Sequence: Synthetic oligonucleotide"
acuucaaauugaauauucugcau

SEQ ID NO: 1371 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacugctucaaauugaauauucu

SEQ ID NO: 1372 - skipped

SEQ ID NO: 1373 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautaucaugcauacaucuc

SEQ ID NO: 1374 - RNA, 23 nt, Artificial Sequence
  source: /note="Description of Artificial Sequence: Synthetic oligonucleotide"
aaauaaagcuuugcagcauugau

SEQ ID NO: 1375 - RNA, 23 nt, Artificial Sequence
  source: /note="Description of Artificial Sequence: Synthetic oligonucleotide"
aaaaaugugaaauaaagcuuugc

SEQ ID NO: 1376 - RNA, 23 nt, Artificial Sequence
  source: /note="Description of Artificial Sequence: Synthetic oligonucleotide"
agccaaccacugcuucaaauuga

SEQ ID NO: 1377 - RNA, 23 nt, Artificial Sequence
  source: /note="Description of Artificial Sequence: Synthetic oligonucleotide"
gaaauaaagcuuugcagcauuga

SEQ ID NO: 1378 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augaaataaagcuuugcagcauu

SEQ ID NO: 1379 - skipped

SEQ ID NO: 1380 - RNA, 23 nt, Artificial Sequence
  source: /note="Description of Artificial Sequence: Synthetic oligonucleotide"
aggaagacagguaauuaaucuug

SEQ ID NO: 1381 - RNA, 23 nt, Artificial Sequence
  source: /note="Description of Artificial Sequence: Synthetic oligonucleotide"
acaggaagacagguaauuaaucu

SEQ ID NO: 1382 - RNA, 23 nt, Artificial Sequence
  source: /note="Description of Artificial Sequence: Synthetic oligonucleotide"
aaacaggaagacagguaauuaau

SEQ ID NO: 1383 - RNA, 23 nt, Artificial Sequence
  source: /note="Description of Artificial Sequence: Synthetic oligonucleotide"
ugagaaacaggaagacagguaau

SEQ ID NO: 1384 - RNA, 23 nt, Artificial Sequence
  source: /note="Description of Artificial Sequence: Synthetic oligonucleotide"
uugagaaacaggaagacagguaa

SEQ ID NO: 1385 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucutgagaaacaggaagaca

SEQ ID NO: 1386 - RNA, 23 nt, Artificial Sequence
  source: /note="Description of Artificial Sequence: Synthetic oligonucleotide"
uuaagaggcaugaaaggaaaaac

SEQ ID NO: 1387 - RNA, 23 nt, Artificial Sequence
  source: /note="Description of Artificial Sequence: Synthetic oligonucleotide"
uuuuuaagaggcaugaaaggaaa

SEQ ID NO: 1388 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguuuutaagaggcaugaaagga

SEQ ID NO: 1389 - RNA, 23 nt, Artificial Sequence
  source: /note="Description of Artificial Sequence: Synthetic oligonucleotide"
auagugccaaaccaauguuuuua

SEQ ID NO: 1390 - RNA, 23 nt, Artificial Sequence
  source: /note="Description of Artificial Sequence: Synthetic oligonucleotide"
aaggaagacagguaauuaaucuu

SEQ ID NO: 1391 - RNA, 23 nt, Artificial Sequence
  source: /note="Description of Artificial Sequence: Synthetic oligonucleotide"
aagaaacaggaagacagguaauu

SEQ ID NO: 1392 - RNA, 23 nt, Artificial Sequence
  source: /note="Description of Artificial Sequence: Synthetic oligonucleotide"
auugagaaacaggaagacaggua

SEQ ID NO: 1393 - RNA, 23 nt, Artificial Sequence
  source: /note="Description of Artificial Sequence: Synthetic oligonucleotide"
acaugaaaggaaaaacagaccua

SEQ ID NO: 1394 - RNA, 23 nt, Artificial Sequence
  source: /note="Description of Artificial Sequence: Synthetic oligonucleotide"
agcaugaaaggaaaaacagaccu

SEQ ID NO: 1395 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaccutcccuguguaaauaagu

SEQ ID NO: 1396 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacctucccuguguaaauaag

SEQ ID NO: 1397-1398 - skipped (2 entries)

SEQ ID NO: 1399 - RNA, 23 nt, Artificial Sequence
  source: /note="Description of Artificial Sequence: Synthetic oligonucleotide"
ugaacagucuuaaaccuucccug

SEQ ID NO: 1400 - RNA, 23 nt, Artificial Sequence
  source: /note="Description of Artificial Sequence: Synthetic oligonucleotide"
uugaacagucuuaaaccuucccu

SEQ ID NO: 1401 - skipped

SEQ ID NO: 1402 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuactugaacagucuuaaacc

SEQ ID NO: 1403 - skipped

SEQ ID NO: 1404 - RNA, 23 nt, Artificial Sequence
  source: /note="Description of Artificial Sequence: Synthetic oligonucleotide"
uggaaugcuacuugaacagucuu

SEQ ID NO: 1405 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuggaatgcuacuugaacagucu

SEQ ID NO: 1406-1407 - skipped (2 entries)

SEQ ID NO: 1408 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacagatuggaaugcuacuugaa

SEQ ID NO: 1409-1410 - skipped (2 entries)

SEQ ID NO: 1411 - RNA, 23 nt, Artificial Sequence
  source: /note="Description of Artificial Sequence: Synthetic oligonucleotide"
acuucccuguguaaauaaguucu

SEQ ID NO: 1412 - RNA, 23 nt, Artificial Sequence
  source: /note="Description of Artificial Sequence: Synthetic oligonucleotide"
aucuuaaaccuucccuguguaaa

SEQ ID NO: 1413 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagucutaaaccuucccugugua

SEQ ID NO: 1414 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacagtcuuaaaccuucccugu

SEQ ID NO: 1415 - RNA, 23 nt, Artificial Sequence
  source: /note="Description of Artificial Sequence: Synthetic oligonucleotide"
auugaacagucuuaaaccuuccc

SEQ ID NO: 1416 - RNA, 23 nt, Artificial Sequence
  source: /note="Description of Artificial Sequence: Synthetic oligonucleotide"
auacuugaacagucuuaaaccuu

SEQ ID NO: 1417 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaugctacuugaacagucuuaa

SEQ ID NO: 1418 - RNA, 23 nt, Artificial Sequence
  source: /note="Description of Artificial Sequence: Synthetic oligonucleotide"
agaaugcuacuugaacagucuua

SEQ ID NO: 1419 - RNA, 23 nt, Artificial Sequence
  source: /note="Description of Artificial Sequence: Synthetic oligonucleotide"
aauuggaaugcuacuugaacagu

SEQ ID NO: 1420 - RNA, 23 nt, Artificial Sequence
  source: /note="Description of Artificial Sequence: Synthetic oligonucleotide"
aagauuggaaugcuacuugaaca

SEQ ID NO: 1421 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaggtugagauaaagcugccu

SEQ ID NO: 1422 - RNA, 23 nt, Artificial Sequence
  source: /note="Description of Artificial Sequence: Synthetic oligonucleotide"
uagggaaaucuuucaaaugcuga

SEQ ID NO: 1423 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggctagggaaaucuuucaaa

SEQ ID NO: 1424 - skipped

SEQ ID NO: 1425 - RNA, 23 nt, Artificial Sequence
  source: /note="Description of Artificial Sequence: Synthetic oligonucleotide"
aaaaaggaagaggcuagggaaau

SEQ ID NO: 1426 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augcactcauucuguguucuugu

SEQ ID NO: 1427 - RNA, 23 nt, Artificial Sequence
  source: /note="Description of Artificial Sequence: Synthetic oligonucleotide"
augugcacucauucuguguucuu

SEQ ID NO: 1428 - RNA, 23 nt, Artificial Sequence
  source: /note="Description of Artificial Sequence: Synthetic oligonucleotide"
acugugcacucauucuguguucu

SEQ ID NO: 1429 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuagctgugcacucauucugug

SEQ ID NO: 1430 - RNA, 23 nt, Artificial Sequence
  source: /note="Description of Artificial Sequence: Synthetic oligonucleotide"
aucuuagcugugcacucauucug

SEQ ID NO: 1431 - RNA, 23 nt, Artificial Sequence
  source: /note="Description of Artificial Sequence: Synthetic oligonucleotide"
agaaaucuuucaaaugcugaauc

SEQ ID NO: 1432 - RNA, 23 nt, Artificial Sequence
  source: /note="Description of Artificial Sequence: Synthetic oligonucleotide"
acuagggaaaucuuucaaaugcu

SEQ ID NO: 1433 - RNA, 23 nt, Artificial Sequence
  source: /note="Description of Artificial Sequence: Synthetic oligonucleotide"
agcuagggaaaucuuucaaaugc

SEQ ID NO: 1434-1435 - skipped (2 entries)

SEQ ID NO: 1436 - RNA, 23 nt, Artificial Sequence
  source: /note="Description of Artificial Sequence: Synthetic oligonucleotide"
aaguccagaauagaguugcaccg

SEQ ID NO: 1437 - skipped

SEQ ID NO: 1438 - RNA, 23 nt, Artificial Sequence
  source: /note="Description of Artificial Sequence: Synthetic oligonucleotide"
uaaaguccagaauagaguugcac

SEQ ID NO: 1439 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaagtccagaauagaguugca

SEQ ID NO: 1440-1441 - skipped (2 entries)

SEQ ID NO: 1442 - RNA, 23 nt, Artificial Sequence
  source: /note="Description of Artificial Sequence: Synthetic oligonucleotide"
aggguccacuuuugguggacuuc

SEQ ID NO: 1443-1447 - skipped (5 entries)

SEQ ID NO: 1448 - RNA, 23 nt, Artificial Sequence
  source: /note="Description of Artificial Sequence: Synthetic oligonucleotide"
aagaauagaguugcaccguuuug

SEQ ID NO: 1449 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagaatagaguugcaccguuuu

SEQ ID NO: 1450 - RNA, 23 nt, Artificial Sequence
  source: /note="Description of Artificial Sequence: Synthetic oligonucleotide"
aaaguaauaaaguccagaauaga

SEQ ID NO: 1451 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
gaaauatagaggguccacuuuug

SEQ ID NO: 1452 - RNA, 23 nt, Artificial Sequence
  source: /note="Description of Artificial Sequence: Synthetic oligonucleotide"
agaaauauagaggguccacuuuu

SEQ ID NO: 1453 - RNA, 23 nt, Artificial Sequence
  source: /note="Description of Artificial Sequence: Synthetic oligonucleotide"
agccuaaaauugucuaaacaucu

SEQ ID NO: 1454 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagcctaaaauugucuaaacau

SEQ ID NO: 1455-1458 - skipped (4 entries)

SEQ ID NO: 1459 - RNA, 23 nt, Artificial Sequence
  source: /note="Description of Artificial Sequence: Synthetic oligonucleotide"
auuuuugagccuaaaauugucua

SEQ ID NO: 1460 - skipped

SEQ ID NO: 1461 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuutaauuuuugagccuaaa

SEQ ID NO: 1462 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuagcutuaauuuuugagccuaa

SEQ ID NO: 1463 - RNA, 23 nt, Artificial Sequence
  source: /note="Description of Artificial Sequence: Synthetic oligonucleotide"
uguuagcuuuaauuuuugagccu

SEQ ID NO: 1464 - RNA, 23 nt, Artificial Sequence
  source: /note="Description of Artificial Sequence: Synthetic oligonucleotide"
uguguuagcuuuaauuuuugagc

SEQ ID NO: 1465 - RNA, 23 nt, Artificial Sequence
  source: /note="Description of Artificial Sequence: Synthetic oligonucleotide"
augggaccaaggauauaugaaag

SEQ ID NO: 1466 - RNA, 23 nt, Artificial Sequence
  source: /note="Description of Artificial Sequence: Synthetic oligonucleotide"
accuaaaauugucuaaacaucuc

SEQ ID NO: 1467 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuagctuuaauuuuugagccua

SEQ ID NO: 1468 - RNA, 23 nt, Artificial Sequence
  source: /note="Description of Artificial Sequence: Synthetic oligonucleotide"
auguuagcuuuaauuuuugagcc

SEQ ID NO: 1469 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augugutagcuuuaauuuuugag

SEQ ID NO: 1470 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuccugtguuagcuuuaauuuuu

SEQ ID NO: 1471 - RNA, 23 nt, Artificial Sequence
  source: /note="Description of Artificial Sequence: Synthetic oligonucleotide"
acaguuccuuuuccuguguuagc

SEQ ID NO: 1472 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agccagtacaguuccuuuuccug

SEQ ID NO: 1473-1474 - skipped (2 entries)

SEQ ID NO: 1475 - RNA, 23 nt, Artificial Sequence
  source: /note="Description of Artificial Sequence: Synthetic oligonucleotide"
acaguacaguuccuuuuccugug

SEQ ID NO: 1476 - RNA, 23 nt, Artificial Sequence
  source: /note="Description of Artificial Sequence: Synthetic oligonucleotide"
auaauagccaguacaguuccuuu

SEQ ID NO: 1477 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaguctugauguagugggaguc

SEQ ID NO: 1478-1479 - skipped (2 entries)

SEQ ID NO: 1480 - RNA, 23 nt, Artificial Sequence
  source: /note="Description of Artificial Sequence: Synthetic oligonucleotide"
aagauuagucuugauguaguggg

SEQ ID NO: 1481 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaagatuagucuugauguagug

SEQ ID NO: 1482-1483 - skipped (2 entries)

SEQ ID NO: 1484 - RNA, 23 nt, Artificial Sequence
  source: /note="Description of Artificial Sequence: Synthetic oligonucleotide"
uauaauacaugugaaaaacacac

SEQ ID NO: 1485 - RNA, 23 nt, Artificial Sequence
  source: /note="Description of Artificial Sequence: Synthetic oligonucleotide"
agcauucuauaauacaugugaaa

SEQ ID NO: 1486 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcautcuauaauacaugugaa

SEQ ID NO: 1487-1491 - skipped (5 entries)

SEQ ID NO: 1492 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggataguccaugcaaaagca

SEQ ID NO: 1493 - RNA, 23 nt, Artificial Sequence
  source: /note="Description of Artificial Sequence: Synthetic oligonucleotide"
acaagaggauaguccaugcaaaa

SEQ ID NO: 1494-1495 - skipped (2 entries)

SEQ ID NO: 1496 - RNA, 23 nt, Artificial Sequence
  source: /note="Description of Artificial Sequence: Synthetic oligonucleotide"
auaaaaacaagaggauaguccau

SEQ ID NO: 1497 - RNA, 23 nt, Artificial Sequence
  source: /note="Description of Artificial Sequence: Synthetic oligonucleotide"
aauaaaaacaagaggauagucca

SEQ ID NO: 1498 - RNA, 23 nt, Artificial Sequence
  source: /note="Description of Artificial Sequence: Synthetic oligonucleotide"
uuaauaaaaacaagaggauaguc

SEQ ID NO: 1499 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuagtcuugauguagugggag

SEQ ID NO: 1500 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagautagucuugauguagugg

SEQ ID NO: 1501 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauagtccaugcaaaagcauuc

SEQ ID NO: 1502 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacaaggactgaaccagaau

SEQ ID NO: 1503 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaggactgaaccagaagga

SEQ ID NO: 1504 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuucugcutcugaucacca

SEQ ID NO: 1505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucugatcaccaucauu

SEQ ID NO: 1506 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaucaccaucaucuacuu

SEQ ID NO: 1507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaucaucuacuccuacuuu

SEQ ID NO: 1508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucauctacuccuacuugu

SEQ ID NO: 1509 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaucuactccuacuugga

SEQ ID NO: 1510 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaucuacuccuacuuggau

SEQ ID NO: 1511 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuacucctacuuggaguu

SEQ ID NO: 1512 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuacucctacuuggagucgu

SEQ ID NO: 1513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacuccuactuggagucguu

SEQ ID NO: 1514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacuccuacutggagucguuu

SEQ ID NO: 1515 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccuactuggagucguugu

SEQ ID NO: 1516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuacutggagucguuggu

SEQ ID NO: 1517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuacuuggagucguugguu

SEQ ID NO: 1518 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucguuggtgaaguuuuucau

SEQ ID NO: 1519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugguucugugggauauuaau

SEQ ID NO: 1520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucugugggauauuaauaau

SEQ ID NO: 1521 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugggatatuaauaagcgu

SEQ ID NO: 1522 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugagugccgaaaacuaggu

SEQ ID NO: 1523 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagugccgaaaacuaggcu

SEQ ID NO: 1524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagugccgaaaacuaggcguu

SEQ ID NO: 1525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugccgaaaacuaggcguca

SEQ ID NO: 1526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugccgaaaacuaggcgucau

SEQ ID NO: 1527 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgaaaactaggcgucacu

SEQ ID NO: 1528 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgaaaacuaggcgucacuu

SEQ ID NO: 1529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgaaaactaggcgucacugu

SEQ ID NO: 1530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagagaagagaucuaucgcuu

SEQ ID NO: 1531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaucuaucgcucucuaaa

SEQ ID NO: 1532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaucuatcgcucucuaaau

SEQ ID NO: 1533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuaucgctcucuaaauca

SEQ ID NO: 1534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuaucgcucucuaaaucau

SEQ ID NO: 1535 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaucgcucucuaaaucaggu

SEQ ID NO: 1536 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucgcuctctaaaucagguu

SEQ ID NO: 1537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgcucucuaaaucagguga

SEQ ID NO: 1538 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcucuctaaaucaggugaa

SEQ ID NO: 1539 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcucucuaaaucaggugaau

SEQ ID NO: 1540 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuaaatcaggugaagaaa

SEQ ID NO: 1541 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcugggacaguauauccau

SEQ ID NO: 1542 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugggacaguauauccagu

SEQ ID NO: 1543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacaguatatccagccgauu

SEQ ID NO: 1544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguauauccagccgaucuuu

SEQ ID NO: 1545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaaggatgaagagauuacu

SEQ ID NO: 1546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaaggaugaagagauuacca

SEQ ID NO: 1547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaggaugaagagauuaccaa

SEQ ID NO: 1548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaagacatutgaggucaaca

SEQ ID NO: 1549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacauuugaggucaacaucu

SEQ ID NO: 1550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacauuugaggucaacauccu

SEQ ID NO: 1551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuugaggucaacauccuau

SEQ ID NO: 1552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuugaggtcaacauccuagu

SEQ ID NO: 1553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaggucaacauccuagga

SEQ ID NO: 1554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggucaacauccuaggaca

SEQ ID NO: 1555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggucaacatccuaggacau

SEQ ID NO: 1556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucaacatccuaggacauuu

SEQ ID NO: 1557 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaacaucctaggacauuuu

SEQ ID NO: 1558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacaucctaggacauuuuug

SEQ ID NO: 1559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacauccuaggacauuuuugu

SEQ ID NO: 1560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauccuaggacauuuuugga

SEQ ID NO: 1561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauccuaggacauuuuuggau

SEQ ID NO: 1562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccuaggacauuuuuggauu

SEQ ID NO: 1563 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuaggacatuuuuggauca

SEQ ID NO: 1564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaggacautuuuggaucau

SEQ ID NO: 1565 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacauututggaucacaaa

SEQ ID NO: 1566 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacauuutuggaucacaaaa

SEQ ID NO: 1567 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacauuuutggaucacaaaau

SEQ ID NO: 1568 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuggatcacaaaagcacu

SEQ ID NO: 1569 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggaucacaaaagcacuucu

SEQ ID NO: 1570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaucacaaaagcacuucuu

SEQ ID NO: 1571 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaucacaaaagcacuucuuu

SEQ ID NO: 1572 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaaaagcacuucuuccauu

SEQ ID NO: 1573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaaagcactucuuccaucu

SEQ ID NO: 1574 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaagcacutcuuccaucga

SEQ ID NO: 1575 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagcactucuuccaucgau

SEQ ID NO: 1576 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcacutctuccaucgauu

SEQ ID NO: 1577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcacuucutccaucgauga

SEQ ID NO: 1578 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacuuctuccaucgaugau

SEQ ID NO: 1579 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacuucutccaucgaugauu

SEQ ID NO: 1580 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaaucatggccacaucguu

SEQ ID NO: 1581 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuuaccucaucccauauu

SEQ ID NO: 1582 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuuacctcaucccauauuu

SEQ ID NO: 1583 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accucaucccauauuguucca

SEQ ID NO: 1584 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucccatatuguuccagca

SEQ ID NO: 1585 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccauautgtuccagcaaau

SEQ ID NO: 1586 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccauauugutccagcaaauu

SEQ ID NO: 1587 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuggcutucacagaggucu

SEQ ID NO: 1588 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuuucacagaggucugacau

SEQ ID NO: 1589 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacagaggtcugacaucau

SEQ ID NO: 1590 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacagaggtctgacaucagaa

SEQ ID NO: 1591 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucugacatcagaacuuca

SEQ ID NO: 1592 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggaaaaacugguaucaaa

SEQ ID NO: 1593 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacugguatcaaaaccucauu

SEQ ID NO: 1594 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugguaucaaaaccucaugu

SEQ ID NO: 1595 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugguaucaaaaccucauguu

SEQ ID NO: 1596 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguaucaaaaccucaugucu

SEQ ID NO: 1597 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguaucaaaaccucaugucuu

SEQ ID NO: 1598 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaucaaaaccucaugucucu

SEQ ID NO: 1599 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaaacctcaugucucugcu

SEQ ID NO: 1600 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugcccagtuuuugugaau

SEQ ID NO: 1601 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccaguuutugugaauacugu

SEQ ID NO: 1602 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuugugaatacuggguuca

SEQ ID NO: 1603 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuugugaauacuggguucau

SEQ ID NO: 1604 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaauacuggguucaccaa

SEQ ID NO: 1605 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaauacuggguucaccaaaa

SEQ ID NO: 1606 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauacugggtucaccaaaaa

SEQ ID NO: 1607 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauacugggutcaccaaaaau

SEQ ID NO: 1608 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacugggtucaccaaaaauu

SEQ ID NO: 1609 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacugggutcaccaaaaaucu

SEQ ID NO: 1610 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccaaaaatccaagcacaa

SEQ ID NO: 1611 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccaaaaauccaagcacaau

SEQ ID NO: 1612 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaauccaagcacaagauua

SEQ ID NO: 1613 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauccaagcacaagauuau

SEQ ID NO: 1614 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauccaagcacaagauuauu

SEQ ID NO: 1615 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaagcacaagauuauggcu

SEQ ID NO: 1616 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacaagautauggccugua

SEQ ID NO: 1617 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacaagatuauggccuguau

SEQ ID NO: 1618 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaagautatggccuguauu

SEQ ID NO: 1619 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaagauuauggccuguauuu

SEQ ID NO: 1620 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagauuatggccuguauugu

SEQ ID NO: 1621 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuauggccuguauuggagau

SEQ ID NO: 1622 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccuguautggagacagau

SEQ ID NO: 1623 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccuguatuggagacagauu

SEQ ID NO: 1624 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuguautggagacagauga

SEQ ID NO: 1625 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugaagtcguaagaagucu

SEQ ID NO: 1626 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugaagucgtaagaagucuu

SEQ ID NO: 1627 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagucguaagaagucugaua

SEQ ID NO: 1628 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucguaagaagucugauaga

SEQ ID NO: 1629 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaagaagtctgauagaugga

SEQ ID NO: 1630 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagaagucugauagauggaa

SEQ ID NO: 1631 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaguctgauagauggaau

SEQ ID NO: 1632 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagucugatagauggaaua

SEQ ID NO: 1633 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagucugauagauggaauau

SEQ ID NO: 1634 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucugatagauggaauacu

SEQ ID NO: 1635 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucugauagatggaauacuua

SEQ ID NO: 1636 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugauagauggaauacuuau

SEQ ID NO: 1637 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauggaatacuuaccaauaa

SEQ ID NO: 1638 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauggaauactuaccaauaau

SEQ ID NO: 1639 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaauacutaccaauaaga

SEQ ID NO: 1640 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaauactuaccaauaagaa

SEQ ID NO: 1641 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaauacutaccaauaagaaa

SEQ ID NO: 1642 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauacuuaccaauaagaaaa

SEQ ID NO: 1643 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauacuuaccaauaagaaaau

SEQ ID NO: 1644 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuccaucguauaucaauauu

SEQ ID NO: 1645 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaucgtataucaauaucu

SEQ ID NO: 1646 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaucguauaucaauaucuu

SEQ ID NO: 1647 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucguatatcaauaucuuu

SEQ ID NO: 1648 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagaagutucuuccugaacu

SEQ ID NO: 1649 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaguuucutccugaacgcu

SEQ ID NO: 1650 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguuucutccugaacgcgcu

SEQ ID NO: 1651 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuccugaacgcgccucagu

SEQ ID NO: 1652 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuuuaaaucguaugcagaa

SEQ ID NO: 1653 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuaaatcguaugcagaau

SEQ ID NO: 1654 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuaaaucgtaugcagaaua

SEQ ID NO: 1655 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucguatgcagaauauuca

SEQ ID NO: 1656 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucguaugcagaauauucaau

SEQ ID NO: 1657 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucguaugcagaauauucaauu

SEQ ID NO: 1658 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguaugcagaauauucaauuu

SEQ ID NO: 1659 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcagaatatucaauuugaa

SEQ ID NO: 1660 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagaauatucaauuugaagu

SEQ ID NO: 1661 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauauucaautugaagcaguu

SEQ ID NO: 1662 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauucaautugaagcaguggu

SEQ ID NO: 1663 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauguaugcatgauaaugaua

SEQ ID NO: 1664 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaguuucgaaucaaugcuu

SEQ ID NO: 1665 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaugcugcaaagcuuuauuu

SEQ ID NO: 1666 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcuuuautucacauuuuu

SEQ ID NO: 1667 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaacautgguuuggcacua

SEQ ID NO: 1668 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacauuggtuuggcacuau

SEQ ID NO: 1669 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaacaagatuaauuaccuu

SEQ ID NO: 1670 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaagautaauuaccugucu

SEQ ID NO: 1671 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauuaautaccugucuuccu

SEQ ID NO: 1672 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuaauuaccugucuuccuu

SEQ ID NO: 1673 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauuacctgtcuuccuguuu

SEQ ID NO: 1674 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuaccugucuuccuguuuc

SEQ ID NO: 1675 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaccugtctuccuguuucu

SEQ ID NO: 1676 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaccugucutccuguuucuu

SEQ ID NO: 1677 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuguctuccuguuucuca

SEQ ID NO: 1678 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugucutccuguuucucaa

SEQ ID NO: 1679 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugucuucctguuucucaau

SEQ ID NO: 1680 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucuguututccuuucaugu

SEQ ID NO: 1681 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuguuutuccuuucaugcu

SEQ ID NO: 1682 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuccuutcaugccucuuaa

SEQ ID NO: 1683 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuuucatgccucuuaaaaa

SEQ ID NO: 1684 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucaugcctcuuaaaaacu

SEQ ID NO: 1685 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuccatutaaagguggau

SEQ ID NO: 1686 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuuauutacacagggaagu

SEQ ID NO: 1687 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauuuacacagggaagguuu

SEQ ID NO: 1688 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacagggaagguuuaagacu

SEQ ID NO: 1689 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacagggaagguuuaagacuu

SEQ ID NO: 1690 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggaaggtutaagacuguuu

SEQ ID NO: 1691 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaaggutuaagacuguuca

SEQ ID NO: 1692 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagguutaagacuguucaa

SEQ ID NO: 1693 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagguuuaagacuguucaau

SEQ ID NO: 1694 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagguuuaagacuguucaagu

SEQ ID NO: 1695 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguuuaagacuguucaagua

SEQ ID NO: 1696 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuuaagactguucaaguau

SEQ ID NO: 1697 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaagactgtucaaguagca

SEQ ID NO: 1698 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagacugtucaaguagcauu

SEQ ID NO: 1699 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacugutcaaguagcauuu

SEQ ID NO: 1700 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacuguucaaguagcauucu

SEQ ID NO: 1701 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuguucaaguagcauucca

SEQ ID NO: 1702 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuguucaagtagcauuccaa

SEQ ID NO: 1703 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguucaaguagcauuccaau

SEQ ID NO: 1704 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguucaagtagcauuccaauu

SEQ ID NO: 1705 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucaaguagcauuccaaucu

SEQ ID NO: 1706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaguagcauuccaaucuu

SEQ ID NO: 1707 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaguagcautccaaucugua

SEQ ID NO: 1708 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguagcatuccaaucuguau

SEQ ID NO: 1709 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcauuccaatcuguagccau

SEQ ID NO: 1710 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauaucaacaagaacacaga

SEQ ID NO: 1711 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaacacagaaugagugcau

SEQ ID NO: 1712 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacacagaatgagugcacau

SEQ ID NO: 1713 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacacagaaugagugcacagu

SEQ ID NO: 1714 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaugagugcacagcuaau

SEQ ID NO: 1715 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcagcutuaucucaaccuu

SEQ ID NO: 1716 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcuuuaucucaaccugga

SEQ ID NO: 1717 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagcautugaaagauuucu

SEQ ID NO: 1718 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcauuugaaagauuucccua

SEQ ID NO: 1719 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuugaaagauuucccuagu

SEQ ID NO: 1720 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuugaaagatuucccuagcu

SEQ ID NO: 1721 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaagautucccuagccucu

SEQ ID NO: 1722 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagauutcccuagccucuu

SEQ ID NO: 1723 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccuagcctcuuccuuuuu

SEQ ID NO: 1724 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacggugcaacucuauucu

SEQ ID NO: 1725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacggugcaacucuauucuu

SEQ ID NO: 1726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacggugcaacucuauucugu

SEQ ID NO: 1727 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugcaactctauucuggacu

SEQ ID NO: 1728 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcaacucuauucuggacuu

SEQ ID NO: 1729 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaacuctatucuggacuuu

SEQ ID NO: 1730 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaacucuautcuggacuuua

SEQ ID NO: 1731 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacucuatucuggacuuuau

SEQ ID NO: 1732 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacucuautctggacuuuauu

SEQ ID NO: 1733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucuauucuggacuuuauua

SEQ ID NO: 1734 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuauuctggacuuuauuau

SEQ ID NO: 1735 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauucuggactuuauuacuuu

SEQ ID NO: 1736 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucuggacutuauuacuuga

SEQ ID NO: 1737 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuggactutauuacuugau

SEQ ID NO: 1738 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaguccaccaaaaguggau

SEQ ID NO: 1739 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaaaaguggacccucuauau

SEQ ID NO: 1740 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaaguggacccucuauauu

SEQ ID NO: 1741 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaguggacccucuauauuuc

SEQ ID NO: 1742 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguggaccctcuauauuucu

SEQ ID NO: 1743 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucauatatccuugguccu

SEQ ID NO: 1744 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucauauatccuuggucccau

SEQ ID NO: 1745 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauguuuagacaauuuuaggu

SEQ ID NO: 1746 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuuagacaauuuuaggcu

SEQ ID NO: 1747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuagacaatuuuaggcuca

SEQ ID NO: 1748 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuagacaautuuaggcucaa

SEQ ID NO: 1749 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagacaatutuaggcucaaa

SEQ ID NO: 1750 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagacaaututaggcucaaaa

SEQ ID NO: 1751 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaauuutaggcucaaaaau

SEQ ID NO: 1752 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaggcucaaaaauuaaagcu

SEQ ID NO: 1753 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggcucaaaaauuaaagcua

SEQ ID NO: 1754 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcucaaaaauuaaagcuaa

SEQ ID NO: 1755 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcucaaaaatuaaagcuaau

SEQ ID NO: 1756 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucaaaaautaaagcuaaca

SEQ ID NO: 1757 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucaaaaatuaaagcuaacau

SEQ ID NO: 1758 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaaaautaaagcuaacaca

SEQ ID NO: 1759 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaaauuaaagcuaacacau

SEQ ID NO: 1760 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauuaaagctaacacaggaa

SEQ ID NO: 1761 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuaacacaggaaaaggaau

SEQ ID NO: 1762 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacacaggaaaaggaacugu

SEQ ID NO: 1763 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaggaaaaggaacuguacu

SEQ ID NO: 1764 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggaaaaggaacuguacugu

SEQ ID NO: 1765 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaacugtacuggcuauuau

SEQ ID NO: 1766 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaacuguactggcuauuaca

SEQ ID NO: 1767 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgacucccactacaucaagau

SEQ ID NO: 1768 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucccacuacaucaagacuaa

SEQ ID NO: 1769 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccacuacatcaagacuaau

SEQ ID NO: 1770 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccacuacaucaagacuaauu

SEQ ID NO: 1771 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacuacatcaagacuaaucu

SEQ ID NO: 1772 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacuacaucaagacuaaucuu

SEQ ID NO: 1773 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuacaucaagacuaaucuuu

SEQ ID NO: 1774 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacaucaagacuaaucuugu

SEQ ID NO: 1775 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaucaagacuaaucuuguu

SEQ ID NO: 1776 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaucaagactaaucuuguuu

SEQ ID NO: 1777 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugugututucacauguau

SEQ ID NO: 1778 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguuuuucacauguauuaua

SEQ ID NO: 1779 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacauguautauagaaugcu

SEQ ID NO: 1780 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacauguatuauagaaugcuu

SEQ ID NO: 1781 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguauuauagaaugcuuuugu

SEQ ID NO: 1782 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guauuauagaaugcuuuugca

SEQ ID NO: 1783 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauagaaugctuuugcaugga

SEQ ID NO: 1784 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaugcututgcauggacua

SEQ ID NO: 1785 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaugcuutugcauggacuau

SEQ ID NO: 1786 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcuuuugcauggacuaucu

SEQ ID NO: 1787 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuugcatggacuauccucu

SEQ ID NO: 1788 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcauggactauccucuugu

SEQ ID NO: 1789 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcauggacuauccucuuguu

SEQ ID NO: 1790 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcauggactatccucuuguuu

SEQ ID NO: 1791 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauggacuauccucuuguuuu

SEQ ID NO: 1792 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggacuatccucuuguuuuu

SEQ ID NO: 1793 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacuaucctcuuguuuuua

SEQ ID NO: 1794 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacuauccucuuguuuuuau

SEQ ID NO: 1795 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuaucctctuguuuuuauu

SEQ ID NO: 1796 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuauccuctuguuuuuauuaa

SEQ ID NO: 1797 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuctgguucaguccuuguguag

SEQ ID NO: 1798 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccutctgguucaguccuugugu

SEQ ID NO: 1799 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggugatcagaagcagaaggauu

SEQ ID NO: 1800 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugauggugatcagaagcagaa

SEQ ID NO: 1801 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaguagaugauggtgaucagaag

SEQ ID NO: 1802 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagtaggaguagaugaugguga

SEQ ID NO: 1803 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaaguaggagtagaugauggug

SEQ ID NO: 1804 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaagtaggaguagaugauggu

SEQ ID NO: 1805 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atccaaguaggagtagaugaugg

SEQ ID NO: 1806 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacuccaaguaggaguagaugau

SEQ ID NO: 1807 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgacuccaagtaggaguagaug

SEQ ID NO: 1808 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgactccaaguaggaguagau

SEQ ID NO: 1809 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacgacuccaagtaggaguaga

SEQ ID NO: 1810 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaacgacuccaaguaggaguag

SEQ ID NO: 1811 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accaacgacuccaaguaggagua

SEQ ID NO: 1812 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaccaacgacuccaaguaggagu

SEQ ID NO: 1813 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgaaaaacuucaccaacgacuc

SEQ ID NO: 1814 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuaauaucccacagaaccaaua

SEQ ID NO: 1815 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuatuaauaucccacagaacca

SEQ ID NO: 1816 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgctuauuaatatcccacagaa

SEQ ID NO: 1817 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accuagtuuucggcacucagcug

SEQ ID NO: 1818 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctaguuuucggcacucagcu

SEQ ID NO: 1819 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgcctaguutucggcacucag

SEQ ID NO: 1820 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacgccuagututcggcacuca

SEQ ID NO: 1821 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgacgccuagtutucggcacuc

SEQ ID NO: 1822 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugacgccuagutuucggcacu

SEQ ID NO: 1823 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagugacgccuagtuuucggcac

SEQ ID NO: 1824 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtgacgcctaguuuucggca

SEQ ID NO: 1825 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcgatagaucucuucucuguu

SEQ ID NO: 1826 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuagagagcgauagaucucuuc

SEQ ID NO: 1827 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuuagagagcgatagaucucuu

SEQ ID NO: 1828 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugautuagagagcgauagaucuc

SEQ ID NO: 1829 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgatutagagagcgauagaucu

SEQ ID NO: 1830 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accugatuuagagagcgauagau

SEQ ID NO: 1831 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacctgauuuagagagcgauaga

SEQ ID NO: 1832 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaccugauuuagagagcgauag

SEQ ID NO: 1833 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacctgauutagagagcgaua

SEQ ID NO: 1834 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atucaccugautuagagagcgau

SEQ ID NO: 1835 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuctucaccugatuuagagagc

SEQ ID NO: 1836 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atggauauacugucccagcauua

SEQ ID NO: 1837 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuggatauactgtcccagcauu

SEQ ID NO: 1838 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucggcuggatatacuguccca

SEQ ID NO: 1839 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagaucggcuggauauacuguc

SEQ ID NO: 1840 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguaaucucuucatccuuggugc

SEQ ID NO: 1841 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguaatcucutcauccuuggug

SEQ ID NO: 1842 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtaaucuctucauccuuggu

SEQ ID NO: 1843 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguugaccucaaatgucuuggua

SEQ ID NO: 1844 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaugutgacctcaaaugucuug

SEQ ID NO: 1845 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggatgtugaccucaaaugucuu

SEQ ID NO: 1846 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataggatguugaccucaaauguc

SEQ ID NO: 1847 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuaggauguugaccucaaaugu

SEQ ID NO: 1848 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuaggaugutgaccucaaaug

SEQ ID NO: 1849 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguccuaggaugutgaccucaaa

SEQ ID NO: 1850 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgucctaggatgtugaccucaa

SEQ ID NO: 1851 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauguccuaggatguugaccuc

SEQ ID NO: 1852 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaatgtccuaggauguugaccu

SEQ ID NO: 1853 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaaaatgucctaggauguugac

SEQ ID NO: 1854 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaaaaauguccuaggauguuga

SEQ ID NO: 1855 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaaaaaugucctaggauguug

SEQ ID NO: 1856 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atccaaaaaugtccuaggauguu

SEQ ID NO: 1857 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauccaaaaauguccuaggaugu

SEQ ID NO: 1858 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugauccaaaaatgtccuaggaug

SEQ ID NO: 1859 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgatccaaaaauguccuaggau

SEQ ID NO: 1860 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugtgauccaaaaauguccuag

SEQ ID NO: 1861 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuugugauccaaaaauguccua

SEQ ID NO: 1862 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuutgtgauccaaaaauguccu

SEQ ID NO: 1863 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugcutuugugatccaaaaaug

SEQ ID NO: 1864 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaagugcuuutgtgauccaaaa

SEQ ID NO: 1865 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaagtgcuutugugauccaaa

SEQ ID NO: 1866 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagaagugcututgugauccaa

SEQ ID NO: 1867 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauggaagaagtgcuuuugugau

SEQ ID NO: 1868 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauggaagaagugcuuuuguga

SEQ ID NO: 1869 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgatggaagaagtgcuuuugug

SEQ ID NO: 1870 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcgauggaagaagugcuuuugu

SEQ ID NO: 1871 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucgatggaagaagugcuuuug

SEQ ID NO: 1872 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaucgauggaagaagugcuuuu

SEQ ID NO: 1873 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcatcgauggaagaagugcuuu

SEQ ID NO: 1874 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucaucgauggaagaagugcuu

SEQ ID NO: 1875 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgauguggccatgauuucucu

SEQ ID NO: 1876 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatgggaugagguaaggaauc

SEQ ID NO: 1877 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauaugggaugagguaaggaau

SEQ ID NO: 1878 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggaacaauaugggaugagguaa

SEQ ID NO: 1879 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuggaacaatatgggaugagg

SEQ ID NO: 1880 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuugctggaacaauaugggaug

SEQ ID NO: 1881 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauutgcuggaacaauaugggau

SEQ ID NO: 1882 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaccucugugaaagccaacagc

SEQ ID NO: 1883 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgucagaccucugugaaagcca

SEQ ID NO: 1884 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgatgtcagacctcugugaaag

SEQ ID NO: 1885 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcugatgucagaccucugugaa

SEQ ID NO: 1886 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaagutcugatgtcagaccucu

SEQ ID NO: 1887 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugauaccagtutuucccaagg

SEQ ID NO: 1888 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugagguuuugataccaguuuu

SEQ ID NO: 1889 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaugagguuutgauaccaguuu

SEQ ID NO: 1890 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacatgagguutugauaccaguu

SEQ ID NO: 1891 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacaugaggututgauaccagu

SEQ ID NO: 1892 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacatgaggtutugauaccag

SEQ ID NO: 1893 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagacaugaggutuugauacca

SEQ ID NO: 1894 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcagagacaugagguuuugaua

SEQ ID NO: 1895 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atucacaaaaacugggcagagac

SEQ ID NO: 1896 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtatucacaaaaacugggca

SEQ ID NO: 1897 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacccaguatucacaaaaacu

SEQ ID NO: 1898 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgaacccaguautcacaaaaac

SEQ ID NO: 1899 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtgaacccagtauucacaaa

SEQ ID NO: 1900 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuuggtgaacccaguauucaca

SEQ ID NO: 1901 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuutggugaacccaguauucac

SEQ ID NO: 1902 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuutuggugaacccaguauuca

SEQ ID NO: 1903 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauututggugaacccaguauuc

SEQ ID NO: 1904 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaututuggugaacccaguauu

SEQ ID NO: 1905 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgugctuggatutuuggugaac

SEQ ID NO: 1906 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugtgcuuggautuuuggugaa

SEQ ID NO: 1907 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucutgugctuggauuuuugg

SEQ ID NO: 1908 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataatctugugcutggauuuuug

SEQ ID NO: 1909 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaaucuugugctuggauuuuu

SEQ ID NO: 1910 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agccauaaucutgtgcuuggauu

SEQ ID NO: 1911 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaggccauaaucuugugcuug

SEQ ID NO: 1912 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atacaggccauaatcuugugcuu

SEQ ID NO: 1913 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauacaggccataaucuugugcu

SEQ ID NO: 1914 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauacaggccauaaucuugugc

SEQ ID NO: 1915 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaatacaggccataaucuugug

SEQ ID NO: 1916 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcuccaauacaggccauaaucu

SEQ ID NO: 1917 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcugucuccaauacaggccaua

SEQ ID NO: 1918 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauctgtcuccaatacaggccau

SEQ ID NO: 1919 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaucugucuccaauacaggcca

SEQ ID NO: 1920 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agactucuuacgacuucaucugu

SEQ ID NO: 1921 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacutcuuacgacuucaucug

SEQ ID NO: 1922 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucagacuuctuacgacuucau

SEQ ID NO: 1923 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuatcagacutctuacgacuuc

SEQ ID NO: 1924 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccatctaucagacuucuuacga

SEQ ID NO: 1925 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccaucuaucagacuucuuacg

SEQ ID NO: 1926 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuccatcuaucagacuucuuac

SEQ ID NO: 1927 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauuccaucuatcagacuucuua

SEQ ID NO: 1928 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atautccaucuaucagacuucuu

SEQ ID NO: 1929 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguatuccauctatcagacuucu

SEQ ID NO: 1930 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtatuccatctaucagacuu

SEQ ID NO: 1931 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaguauuccaucuaucagacu

SEQ ID NO: 1932 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utautgguaagtatuccaucuau

SEQ ID NO: 1933 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuatugguaaguauuccaucua

SEQ ID NO: 1934 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuuautgguaagtauuccaucu

SEQ ID NO: 1935 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcutatugguaaguauuccauc

SEQ ID NO: 1936 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuctuauuggtaaguauuccau

SEQ ID NO: 1937 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuucutauugguaaguauucca

SEQ ID NO: 1938 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuutctuauuggtaaguauucc

SEQ ID NO: 1939 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatugauauacgauggaacaa

SEQ ID NO: 1940 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauautgauatacgauggaaca

SEQ ID NO: 1941 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatatugauauacgauggaac

SEQ ID NO: 1942 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagauauugatatacgauggaa

SEQ ID NO: 1943 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguucaggaagaaacuucuguag

SEQ ID NO: 1944 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcgtucaggaagaaacuucugu

SEQ ID NO: 1945 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcgcgtucaggaagaaacuucu

SEQ ID NO: 1946 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugaggcgcgtucaggaagaaa

SEQ ID NO: 1947 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcugcauacgautuaaaaucgc

SEQ ID NO: 1948 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuctgcauacgatuuaaaaucg

SEQ ID NO: 1949 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucugcauacgauuuaaaauc

SEQ ID NO: 1950 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaatatucugcatacgauuuaa

SEQ ID NO: 1951 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugaatauuctgcauacgauuu

SEQ ID NO: 1952 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauugaauauucugcauacgauu

SEQ ID NO: 1953 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaautgaauautctgcauacgau

SEQ ID NO: 1954 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcaaatugaatatucugcauac

SEQ ID NO: 1955 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucaaauugaatauucugcau

SEQ ID NO: 1956 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacugctucaaautgaauauucu

SEQ ID NO: 1957 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accacugcuucaaauugaauauu

SEQ ID NO: 1958 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautaucatgcauacaucuc

SEQ ID NO: 1959 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcautgauucgaaacuauuca

SEQ ID NO: 1960 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauaaagcuutgcagcauugau

SEQ ID NO: 1961 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaaugugaaauaaagcuuugc

SEQ ID NO: 1962 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagugccaaaccaauguuuuuaa

SEQ ID NO: 1963 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atagtgccaaaccaauguuuuua

SEQ ID NO: 1964 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggtaauuaatctuguucguuu

SEQ ID NO: 1965 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacagguaautaaucuuguucg

SEQ ID NO: 1966 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggaagacaggtaauuaaucuug

SEQ ID NO: 1967 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggaagacagguaauuaaucuu

SEQ ID NO: 1968 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacaggaagacagguaauuaau

SEQ ID NO: 1969 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
gaaacaggaagacagguaauuaa

SEQ ID NO: 1970 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaacaggaagacagguaauua

SEQ ID NO: 1971 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaaacaggaagacagguaauu

SEQ ID NO: 1972 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagaaacaggaagacagguaau

SEQ ID NO: 1973 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgagaaacaggaagacagguaa

SEQ ID NO: 1974 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugagaaacaggaagacaggua

SEQ ID NO: 1975 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaugaaaggaaaaacagaccua

SEQ ID NO: 1976 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcatgaaaggaaaaacagaccu

SEQ ID NO: 1977 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaagaggcaugaaaggaaaaac

SEQ ID NO: 1978 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuutaagaggcatgaaaggaaa

SEQ ID NO: 1979 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguututaagaggcaugaaagga

SEQ ID NO: 1980 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atccaccuuuaaatggaaaaaua

SEQ ID NO: 1981 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucccugugtaaauaaguucu

SEQ ID NO: 1982 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaccutcccuguguaaauaagu

SEQ ID NO: 1983 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguctuaaacctucccuguguaa

SEQ ID NO: 1984 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagucutaaaccutcccugugua

SEQ ID NO: 1985 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacagtcuuaaaccuucccugu

SEQ ID NO: 1986 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacagucuuaaaccuucccug

SEQ ID NO: 1987 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgaacagucutaaaccuucccu

SEQ ID NO: 1988 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugaacaguctuaaaccuuccc

SEQ ID NO: 1989 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuugaacagucutaaaccuucc

SEQ ID NO: 1990 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacutgaacagtctuaaaccuuc

SEQ ID NO: 1991 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atactugaacagucuuaaaccuu

SEQ ID NO: 1992 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuactugaacagucuuaaacc

SEQ ID NO: 1993 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugcuacuugaacagucuuaaa

SEQ ID NO: 1994 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaugctacuugaacagucuuaa

SEQ ID NO: 1995 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaatgcuacutgaacagucuua

SEQ ID NO: 1996 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggaaugcuactugaacagucuu

SEQ ID NO: 1997 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggaatgcuacutgaacagucu

SEQ ID NO: 1998 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuggaaugcuactugaacaguc

SEQ ID NO: 1999 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuggaaugctacuugaacagu

SEQ ID NO: 2000 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautggaaugcuacuugaacag

SEQ ID NO: 2001 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatuggaaugctacuugaaca

SEQ ID NO: 2002 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacagatuggaaugcuacuugaa

SEQ ID NO: 2003 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atacagauuggaatgcuacuuga

SEQ ID NO: 2004 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atggcuacagatuggaaugcuac

SEQ ID NO: 2005 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtgtucuugutgauauucug

SEQ ID NO: 2006 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgcactcauucuguguucuugu

SEQ ID NO: 2007 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgugcacucatucuguguucuu

SEQ ID NO: 2008 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugtgcacucautcuguguucu

SEQ ID NO: 2009 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuagctgugcactcauucugug

SEQ ID NO: 2010 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggtugagauaaagcugccugc

SEQ ID NO: 2011 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaggtugagauaaagcugccu

SEQ ID NO: 2012 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaaucuuucaaaugcugaauc

SEQ ID NO: 2013 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagggaaaucutucaaaugcuga

SEQ ID NO: 2014 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuagggaaaucutucaaaugcu

SEQ ID NO: 2015 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcuagggaaatctuucaaaugc

SEQ ID NO: 2016 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggctagggaaaucuuucaaa

SEQ ID NO: 2017 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaggcuagggaaaucuuucaa

SEQ ID NO: 2018 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaaggaagaggcuagggaaau

SEQ ID NO: 2019 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaatagaguugcaccguuuugg

SEQ ID NO: 2020 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaauagagutgcaccguuuug

SEQ ID NO: 2021 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagaatagagtugcaccguuuu

SEQ ID NO: 2022 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguccagaauagaguugcaccgu

SEQ ID NO: 2023 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaguccagaauagaguugcaccg

SEQ ID NO: 2024 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagtccagaatagaguugcacc

SEQ ID NO: 2025 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaaguccagaauagaguugcac

SEQ ID NO: 2026 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaagtccagaatagaguugca

SEQ ID NO: 2027 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaaaguccagaauagaguugc

SEQ ID NO: 2028 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauaaaguccagaauagaguug

SEQ ID NO: 2029 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataataaaguccagaauagaguu

SEQ ID NO: 2030 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagtaauaaaguccagaauaga

SEQ ID NO: 2031 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaguaauaaagtccagaauag

SEQ ID NO: 2032 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcaagtaauaaaguccagaaua

SEQ ID NO: 2033 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atccactuuugguggacuucaga

SEQ ID NO: 2034 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atauagaggguccacuuuuggug

SEQ ID NO: 2035 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatagagggtccacuuuuggu

SEQ ID NO: 2036 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
gaaatatagagggtccacuuuug

SEQ ID NO: 2037 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaauauagaggguccacuuuu

SEQ ID NO: 2038 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggaccaaggatataugaaagca

SEQ ID NO: 2039 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgggaccaaggatauaugaaag

SEQ ID NO: 2040 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accuaaaauugtctaaacaucuc

SEQ ID NO: 2041 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctaaaauugucuaaacaucu

SEQ ID NO: 2042 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagcctaaaatugucuaaacau

SEQ ID NO: 2043 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgagccuaaaautgucuaaaca

SEQ ID NO: 2044 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugagccuaaaatugucuaaac

SEQ ID NO: 2045 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuugagccuaaaauugucuaaa

SEQ ID NO: 2046 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuutugagcctaaaauugucua

SEQ ID NO: 2047 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutuaauuutugagccuaaaa

SEQ ID NO: 2048 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagctutaauututgagccuaaa

SEQ ID NO: 2049 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utagcutuaaututugagccuaa

SEQ ID NO: 2050 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuagctuuaatutuugagccua

SEQ ID NO: 2051 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguuagcuuuaautuuugagccu

SEQ ID NO: 2052 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgutagcuuuaatuuuugagcc

SEQ ID NO: 2053 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugtuagcuutaauuuuugagc

SEQ ID NO: 2054 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgugutagcutuaauuuuugag

SEQ ID NO: 2055 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcctgtguuagctuuaauuuuu

SEQ ID NO: 2056 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuccutuucctgtguuagcuuu

SEQ ID NO: 2057 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtuccuuutccuguguuagc

SEQ ID NO: 2058 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguacaguucctutuccuguguu

SEQ ID NO: 2059 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtacaguucctuuuccugug

SEQ ID NO: 2060 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataatagccagtacaguuccuuu

SEQ ID NO: 2061 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaauagccaguacaguuccuu

SEQ ID NO: 2062 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcutgauguagugggagucgga

SEQ ID NO: 2063 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utagtctugauguagugggaguc

SEQ ID NO: 2064 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuagucuugatgtagugggagu

SEQ ID NO: 2065 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuagtcuugauguagugggag

SEQ ID NO: 2066 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautagucuugatguaguggga

SEQ ID NO: 2067 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatuagucutgauguaguggg

SEQ ID NO: 2068 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagautaguctugauguagugg

SEQ ID NO: 2069 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaagatuagucutgauguagug

SEQ ID NO: 2070 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaagauuagtctugauguagu

SEQ ID NO: 2071 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacaagauuagucuugauguag

SEQ ID NO: 2072 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atacaugugaaaaacacacaaaa

SEQ ID NO: 2073 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaauacaugtgaaaaacacac

SEQ ID NO: 2074 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcatucuauaauacaugugaaa

SEQ ID NO: 2075 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcautcuauaatacaugugaa

SEQ ID NO: 2076 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaaaagcauucuauaauacaug

SEQ ID NO: 2077 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaaagcautctauaauacau

SEQ ID NO: 2078 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccatgcaaaagcauucuauaau

SEQ ID NO: 2079 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguccaugcaaaagcauucuau

SEQ ID NO: 2080 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atagtccaugcaaaagcauucua

SEQ ID NO: 2081 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauagtccaugcaaaagcauuc

SEQ ID NO: 2082 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggataguccatgcaaaagca

SEQ ID NO: 2083 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaagaggauaguccaugcaaaa

SEQ ID NO: 2084 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaagaggauagtccaugcaaa

SEQ ID NO: 2085 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacaagaggataguccaugcaa

SEQ ID NO: 2086 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaacaagaggauaguccaugca

SEQ ID NO: 2087 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaacaagaggataguccaugc

SEQ ID NO: 2088 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaaaacaagaggauaguccaug

SEQ ID NO: 2089 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaacaagaggauaguccau

SEQ ID NO: 2090 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaaaaacaagaggauagucca

SEQ ID NO: 2091 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaataaaaacaagaggauaguc

SEQ ID NO: 2092 - RNA, 23 nt, Artificial Sequence
  source: /note="Description of Artificial Sequence: Synthetic oligonucleotide"
cuacacaaggacugaaccagaag

SEQ ID NO: 2093 - RNA, 23 nt, Artificial Sequence
  source: /note="Description of Artificial Sequence: Synthetic oligonucleotide"
acacaaggacugaaccagaagga

SEQ ID NO: 2094 - RNA, 23 nt, Artificial Sequence
  source: /note="Description of Artificial Sequence: Synthetic oligonucleotide"
aauccuucugcuucugaucacca

SEQ ID NO: 2095 - RNA, 23 nt, Artificial Sequence
  source: /note="Description of Artificial Sequence: Synthetic oligonucleotide"
uucugcuucugaucaccaucauc

SEQ ID NO: 2096 - RNA, 23 nt, Artificial Sequence
  source: /note="Description of Artificial Sequence: Synthetic oligonucleotide"
cuucugaucaccaucaucuacuc

SEQ ID NO: 2097 - RNA, 23 nt, Artificial Sequence
  source: /note="Description of Artificial Sequence: Synthetic oligonucleotide"
ucaccaucaucuacuccuacuug

SEQ ID NO: 2098 - RNA, 23 nt, Artificial Sequence
  source: /note="Description of Artificial Sequence: Synthetic oligonucleotide"
caccaucaucuacuccuacuugg

SEQ ID NO: 2099 - RNA, 23 nt, Artificial Sequence
  source: /note="Description of Artificial Sequence: Synthetic oligonucleotide"
accaucaucuacuccuacuugga

SEQ ID NO: 2100 - RNA, 23 nt, Artificial Sequence
  source: /note="Description of Artificial Sequence: Synthetic oligonucleotide"
ccaucaucuacuccuacuuggag

SEQ ID NO: 2101 - RNA, 23 nt, Artificial Sequence
  source: /note="Description of Artificial Sequence: Synthetic oligonucleotide"
aucaucuacuccuacuuggaguc

SEQ ID NO: 2102 - RNA, 23 nt, Artificial Sequence
  source: /note="Description of Artificial Sequence: Synthetic oligonucleotide"
caucuacuccuacuuggagucgu

SEQ ID NO: 2103 - RNA, 23 nt, Artificial Sequence
  source: /note="Description of Artificial Sequence: Synthetic oligonucleotide"
aucuacuccuacuuggagucguu

SEQ ID NO: 2104 - RNA, 23 nt, Artificial Sequence
  source: /note="Description of Artificial Sequence: Synthetic oligonucleotide"
ucuacuccuacuuggagucguug

SEQ ID NO: 2105 - RNA, 23 nt, Artificial Sequence
  source: /note="Description of Artificial Sequence: Synthetic oligonucleotide"
cuacuccuacuuggagucguugg

SEQ ID NO: 2106 - RNA, 23 nt, Artificial Sequence
  source: /note="Description of Artificial Sequence: Synthetic oligonucleotide"
uacuccuacuuggagucguuggu

SEQ ID NO: 2107 - RNA, 23 nt, Artificial Sequence
  source: /note="Description of Artificial Sequence: Synthetic oligonucleotide"
acuccuacuuggagucguuggug

SEQ ID NO: 2108 - RNA, 23 nt, Artificial Sequence
  source: /note="Description of Artificial Sequence: Synthetic oligonucleotide"
gagucguuggugaaguuuuucau

SEQ ID NO: 2109 - RNA, 23 nt, Artificial Sequence
  source: /note="Description of Artificial Sequence: Synthetic oligonucleotide"
uauugguucugugggauauuaau

SEQ ID NO: 2110 - RNA, 23 nt, Artificial Sequence
  source: /note="Description of Artificial Sequence: Synthetic oligonucleotide"
ugguucugugggauauuaauaag

SEQ ID NO: 2111 - RNA, 23 nt, Artificial Sequence
  source: /note="Description of Artificial Sequence: Synthetic oligonucleotide"
uucugugggauauuaauaagcgc

SEQ ID NO: 2112 - RNA, 23 nt, Artificial Sequence
  source: /note="Description of Artificial Sequence: Synthetic oligonucleotide"
cagcugagugccgaaaacuaggc

SEQ ID NO: 2113 - RNA, 23 nt, Artificial Sequence
  source: /note="Description of Artificial Sequence: Synthetic oligonucleotide"
agcugagugccgaaaacuaggcg

SEQ ID NO: 2114 - RNA, 23 nt, Artificial Sequence
  source: /note="Description of Artificial Sequence: Synthetic oligonucleotide"
cugagugccgaaaacuaggcguc

SEQ ID NO: 2115 - RNA, 23 nt, Artificial Sequence
  source: /note="Description of Artificial Sequence: Synthetic oligonucleotide"
ugagugccgaaaacuaggcguca

SEQ ID NO: 2116 - RNA, 23 nt, Artificial Sequence
  source: /note="Description of Artificial Sequence: Synthetic oligonucleotide"
gagugccgaaaacuaggcgucac

SEQ ID NO: 2117 - RNA, 23 nt, Artificial Sequence
  source: /note="Description of Artificial Sequence: Synthetic oligonucleotide"
agugccgaaaacuaggcgucacu

SEQ ID NO: 2118 - RNA, 23 nt, Artificial Sequence
  source: /note="Description of Artificial Sequence: Synthetic oligonucleotide"
gugccgaaaacuaggcgucacug

SEQ ID NO: 2119 - RNA, 23 nt, Artificial Sequence
  source: /note="Description of Artificial Sequence: Synthetic oligonucleotide"
ugccgaaaacuaggcgucacugc

SEQ ID NO: 2120 - RNA, 23 nt, Artificial Sequence
  source: /note="Description of Artificial Sequence: Synthetic oligonucleotide"
aacagagaagagaucuaucgcuc

SEQ ID NO: 2121 - RNA, 23 nt, Artificial Sequence
  source: /note="Description of Artificial Sequence: Synthetic oligonucleotide"
gaagagaucuaucgcucucuaaa

SEQ ID NO: 2122 - RNA, 23 nt, Artificial Sequence
  source: /note="Description of Artificial Sequence: Synthetic oligonucleotide"
aagagaucuaucgcucucuaaau

SEQ ID NO: 2123 - RNA, 23 nt, Artificial Sequence
  source: /note="Description of Artificial Sequence: Synthetic oligonucleotide"
gagaucuaucgcucucuaaauca

SEQ ID NO: 2124 - RNA, 23 nt, Artificial Sequence
  source: /note="Description of Artificial Sequence: Synthetic oligonucleotide"
agaucuaucgcucucuaaaucag

SEQ ID NO: 2125 - RNA, 23 nt, Artificial Sequence
  source: /note="Description of Artificial Sequence: Synthetic oligonucleotide"
aucuaucgcucucuaaaucaggu

SEQ ID NO: 2126 - RNA, 23 nt, Artificial Sequence
  source: /note="Description of Artificial Sequence: Synthetic oligonucleotide"
ucuaucgcucucuaaaucaggug

SEQ ID NO: 2127 - RNA, 23 nt, Artificial Sequence
  source: /note="Description of Artificial Sequence: Synthetic oligonucleotide"
cuaucgcucucuaaaucagguga

SEQ ID NO: 2128 - RNA, 23 nt, Artificial Sequence
  source: /note="Description of Artificial Sequence: Synthetic oligonucleotide"
uaucgcucucuaaaucaggugaa

SEQ ID NO: 2129 - RNA, 23 nt, Artificial Sequence
  source: /note="Description of Artificial Sequence: Synthetic oligonucleotide"
aucgcucucuaaaucaggugaag

SEQ ID NO: 2130 - RNA, 23 nt, Artificial Sequence
  source: /note="Description of Artificial Sequence: Synthetic oligonucleotide"
gcucucuaaaucaggugaagaaa

SEQ ID NO: 2131 - RNA, 23 nt, Artificial Sequence
  source: /note="Description of Artificial Sequence: Synthetic oligonucleotide"
uaaugcugggacaguauauccag

SEQ ID NO: 2132 - RNA, 23 nt, Artificial Sequence
  source: /note="Description of Artificial Sequence: Synthetic oligonucleotide"
aaugcugggacaguauauccagc

SEQ ID NO: 2133 - RNA, 23 nt, Artificial Sequence
  source: /note="Description of Artificial Sequence: Synthetic oligonucleotide"
ugggacaguauauccagccgauc

SEQ ID NO: 2134 - RNA, 23 nt, Artificial Sequence
  source: /note="Description of Artificial Sequence: Synthetic oligonucleotide"
gacaguauauccagccgaucuuc

SEQ ID NO: 2135 - RNA, 23 nt, Artificial Sequence
  source: /note="Description of Artificial Sequence: Synthetic oligonucleotide"
gcaccaaggaugaagagauuacc

SEQ ID NO: 2136 - RNA, 23 nt, Artificial Sequence
  source: /note="Description of Artificial Sequence: Synthetic oligonucleotide"
caccaaggaugaagagauuacca

SEQ ID NO: 2137 - RNA, 23 nt, Artificial Sequence
  source: /note="Description of Artificial Sequence: Synthetic oligonucleotide"
accaaggaugaagagauuaccaa

SEQ ID NO: 2138 - RNA, 23 nt, Artificial Sequence
  source: /note="Description of Artificial Sequence: Synthetic oligonucleotide"
uaccaagacauuugaggucaaca

SEQ ID NO: 2139 - RNA, 23 nt, Artificial Sequence
  source: /note="Description of Artificial Sequence: Synthetic oligonucleotide"
caagacauuugaggucaacaucc

SEQ ID NO: 2140 - RNA, 23 nt, Artificial Sequence
  source: /note="Description of Artificial Sequence: Synthetic oligonucleotide"
aagacauuugaggucaacauccu

SEQ ID NO: 2141 - RNA, 23 nt, Artificial Sequence
  source: /note="Description of Artificial Sequence: Synthetic oligonucleotide"
gacauuugaggucaacauccuag

SEQ ID NO: 2142 - RNA, 23 nt, Artificial Sequence
  source: /note="Description of Artificial Sequence: Synthetic oligonucleotide"
acauuugaggucaacauccuagg

SEQ ID NO: 2143 - RNA, 23 nt, Artificial Sequence
  source: /note="Description of Artificial Sequence: Synthetic oligonucleotide"
cauuugaggucaacauccuagga

SEQ ID NO: 2144 - RNA, 23 nt, Artificial Sequence
  source: /note="Description of Artificial Sequence: Synthetic oligonucleotide"
uuugaggucaacauccuaggaca

SEQ ID NO: 2145 - RNA, 23 nt, Artificial Sequence
  source: /note="Description of Artificial Sequence: Synthetic oligonucleotide"
uugaggucaacauccuaggacau

SEQ ID NO: 2146 - RNA, 23 nt, Artificial Sequence
  source: /note="Description of Artificial Sequence: Synthetic oligonucleotide"
gaggucaacauccuaggacauuu

SEQ ID NO: 2147 - RNA, 23 nt, Artificial Sequence
  source: /note="Description of Artificial Sequence: Synthetic oligonucleotide"
aggucaacauccuaggacauuuu

SEQ ID NO: 2148 - RNA, 23 nt, Artificial Sequence
  source: /note="Description of Artificial Sequence: Synthetic oligonucleotide"
gucaacauccuaggacauuuuug

SEQ ID NO: 2149 - RNA, 23 nt, Artificial Sequence
  source: /note="Description of Artificial Sequence: Synthetic oligonucleotide"
ucaacauccuaggacauuuuugg

SEQ ID NO: 2150 - RNA, 23 nt, Artificial Sequence
  source: /note="Description of Artificial Sequence: Synthetic oligonucleotide"
caacauccuaggacauuuuugga

SEQ ID NO: 2151 - RNA, 23 nt, Artificial Sequence
  source: /note="Description of Artificial Sequence: Synthetic oligonucleotide"
aacauccuaggacauuuuuggau

SEQ ID NO: 2152 - RNA, 23 nt, Artificial Sequence
  source: /note="Description of Artificial Sequence: Synthetic oligonucleotide"
acauccuaggacauuuuuggauc

SEQ ID NO: 2153 - RNA, 23 nt, Artificial Sequence
  source: /note="Description of Artificial Sequence: Synthetic oligonucleotide"
cauccuaggacauuuuuggauca

SEQ ID NO: 2154 - RNA, 23 nt, Artificial Sequence
  source: /note="Description of Artificial Sequence: Synthetic oligonucleotide"
auccuaggacauuuuuggaucac

SEQ ID NO: 2155 - RNA, 23 nt, Artificial Sequence
  source: /note="Description of Artificial Sequence: Synthetic oligonucleotide"
cuaggacauuuuuggaucacaaa

SEQ ID NO: 2156 - RNA, 23 nt, Artificial Sequence
  source: /note="Description of Artificial Sequence: Synthetic oligonucleotide"
uaggacauuuuuggaucacaaaa

SEQ ID NO: 2157 - RNA, 23 nt, Artificial Sequence
  source: /note="Description of Artificial Sequence: Synthetic oligonucleotide"
aggacauuuuuggaucacaaaag

SEQ ID NO: 2158 - RNA, 23 nt, Artificial Sequence
  source: /note="Description of Artificial Sequence: Synthetic oligonucleotide"
cauuuuuggaucacaaaagcacu

SEQ ID NO: 2159 - RNA, 23 nt, Artificial Sequence
  source: /note="Description of Artificial Sequence: Synthetic oligonucleotide"
uuuuggaucacaaaagcacuucu

SEQ ID NO: 2160 - RNA, 23 nt, Artificial Sequence
  source: /note="Description of Artificial Sequence: Synthetic oligonucleotide"
uuuggaucacaaaagcacuucuu

SEQ ID NO: 2161 - RNA, 23 nt, Artificial Sequence
  source: /note="Description of Artificial Sequence: Synthetic oligonucleotide"
uuggaucacaaaagcacuucuuc

SEQ ID NO: 2162 - RNA, 23 nt, Artificial Sequence
  source: /note="Description of Artificial Sequence: Synthetic oligonucleotide"
aucacaaaagcacuucuuccauc

SEQ ID NO: 2163 - RNA, 23 nt, Artificial Sequence
  source: /note="Description of Artificial Sequence: Synthetic oligonucleotide"
ucacaaaagcacuucuuccaucg

SEQ ID NO: 2164 - RNA, 23 nt, Artificial Sequence
  source: /note="Description of Artificial Sequence: Synthetic oligonucleotide"
cacaaaagcacuucuuccaucga

SEQ ID NO: 2165 - RNA, 23 nt, Artificial Sequence
  source: /note="Description of Artificial Sequence: Synthetic oligonucleotide"
acaaaagcacuucuuccaucgau

SEQ ID NO: 2166 - RNA, 23 nt, Artificial Sequence
  source: /note="Description of Artificial Sequence: Synthetic oligonucleotide"
caaaagcacuucuuccaucgaug

SEQ ID NO: 2167 - RNA, 23 nt, Artificial Sequence
  source: /note="Description of Artificial Sequence: Synthetic oligonucleotide"
aaaagcacuucuuccaucgauga

SEQ ID NO: 2168 - RNA, 23 nt, Artificial Sequence
  source: /note="Description of Artificial Sequence: Synthetic oligonucleotide"
aaagcacuucuuccaucgaugau

SEQ ID NO: 2169 - RNA, 23 nt, Artificial Sequence
  source: /note="Description of Artificial Sequence: Synthetic oligonucleotide"
aagcacuucuuccaucgaugaug

SEQ ID NO: 2170 - RNA, 23 nt, Artificial Sequence
  source: /note="Description of Artificial Sequence: Synthetic oligonucleotide"
agagaaaucauggccacaucguc

SEQ ID NO: 2171 - RNA, 23 nt, Artificial Sequence
  source: /note="Description of Artificial Sequence: Synthetic oligonucleotide"
gauuccuuaccucaucccauauu

SEQ ID NO: 2172 - RNA, 23 nt, Artificial Sequence
  source: /note="Description of Artificial Sequence: Synthetic oligonucleotide"
auuccuuaccucaucccauauug

SEQ ID NO: 2173 - RNA, 23 nt, Artificial Sequence
  source: /note="Description of Artificial Sequence: Synthetic oligonucleotide"
uuaccucaucccauauuguucca

SEQ ID NO: 2174 - RNA, 23 nt, Artificial Sequence
  source: /note="Description of Artificial Sequence: Synthetic oligonucleotide"
ccucaucccauauuguuccagca

SEQ ID NO: 2175 - RNA, 23 nt, Artificial Sequence
  source: /note="Description of Artificial Sequence: Synthetic oligonucleotide"
caucccauauuguuccagcaaau

SEQ ID NO: 2176 - RNA, 23 nt, Artificial Sequence
  source: /note="Description of Artificial Sequence: Synthetic oligonucleotide"
aucccauauuguuccagcaaauu

SEQ ID NO: 2177 - RNA, 23 nt, Artificial Sequence
  source: /note="Description of Artificial Sequence: Synthetic oligonucleotide"
gcuguuggcuuucacagaggucu

SEQ ID NO: 2178 - RNA, 23 nt, Artificial Sequence
  source: /note="Description of Artificial Sequence: Synthetic oligonucleotide"
uggcuuucacagaggucugacau

SEQ ID NO: 2179 - RNA, 23 nt, Artificial Sequence
  source: /note="Description of Artificial Sequence: Synthetic oligonucleotide"
cuuucacagaggucugacaucag

SEQ ID NO: 2180 - RNA, 23 nt, Artificial Sequence
  source: /note="Description of Artificial Sequence: Synthetic oligonucleotide"
uucacagaggucugacaucagaa

SEQ ID NO: 2181 - RNA, 23 nt, Artificial Sequence
  source: /note="Description of Artificial Sequence: Synthetic oligonucleotide"
agaggucugacaucagaacuuca

SEQ ID NO: 2182 - RNA, 23 nt, Artificial Sequence
  source: /note="Description of Artificial Sequence: Synthetic oligonucleotide"
ccuugggaaaaacugguaucaaa

SEQ ID NO: 2183 - RNA, 23 nt, Artificial Sequence
  source: /note="Description of Artificial Sequence: Synthetic oligonucleotide"
aaaacugguaucaaaaccucaug

SEQ ID NO: 2184 - RNA, 23 nt, Artificial Sequence
  source: /note="Description of Artificial Sequence: Synthetic oligonucleotide"
aaacugguaucaaaaccucaugu

SEQ ID NO: 2185 - RNA, 23 nt, Artificial Sequence
  source: /note="Description of Artificial Sequence: Synthetic oligonucleotide"
aacugguaucaaaaccucauguc

SEQ ID NO: 2186 - RNA, 23 nt, Artificial Sequence
  source: /note="Description of Artificial Sequence: Synthetic oligonucleotide"
acugguaucaaaaccucaugucu

SEQ ID NO: 2187 - RNA, 23 nt, Artificial Sequence
  source: /note="Description of Artificial Sequence: Synthetic oligonucleotide"
cugguaucaaaaccucaugucuc

SEQ ID NO: 2188 - RNA, 23 nt, Artificial Sequence
  source: /note="Description of Artificial Sequence: Synthetic oligonucleotide"
ugguaucaaaaccucaugucucu

SEQ ID NO: 2189 - RNA, 23 nt, Artificial Sequence
  source: /note="Description of Artificial Sequence: Synthetic oligonucleotide"
uaucaaaaccucaugucucugcc

SEQ ID NO: 2190 - RNA, 23 nt, Artificial Sequence
  source: /note="Description of Artificial Sequence: Synthetic oligonucleotide"
gucucugcccaguuuuugugaau

SEQ ID NO: 2191 - RNA, 23 nt, Artificial Sequence
  source: /note="Description of Artificial Sequence: Synthetic oligonucleotide"
ugcccaguuuuugugaauacugg

SEQ ID NO: 2192 - RNA, 23 nt, Artificial Sequence
  source: /note="Description of Artificial Sequence: Synthetic oligonucleotide"
aguuuuugugaauacuggguuca

SEQ ID NO: 2193 - RNA, 23 nt, Artificial Sequence
  source: /note="Description of Artificial Sequence: Synthetic oligonucleotide"
guuuuugugaauacuggguucac

SEQ ID NO: 2194 - RNA, 23 nt, Artificial Sequence
  source: /note="Description of Artificial Sequence: Synthetic oligonucleotide"
uuugugaauacuggguucaccaa

SEQ ID NO: 2195 - RNA, 23 nt, Artificial Sequence
  source: /note="Description of Artificial Sequence: Synthetic oligonucleotide"
ugugaauacuggguucaccaaaa

SEQ ID NO: 2196 - RNA, 23 nt, Artificial Sequence
  source: /note="Description of Artificial Sequence: Synthetic oligonucleotide"
gugaauacuggguucaccaaaaa

SEQ ID NO: 2197 - RNA, 23 nt, Artificial Sequence
  source: /note="Description of Artificial Sequence: Synthetic oligonucleotide"
ugaauacuggguucaccaaaaau

SEQ ID NO: 2198 - RNA, 23 nt, Artificial Sequence
  source: /note="Description of Artificial Sequence: Synthetic oligonucleotide"
gaauacuggguucaccaaaaauc

SEQ ID NO: 2199 - RNA, 23 nt, Artificial Sequence
  source: /note="Description of Artificial Sequence: Synthetic oligonucleotide"
aauacuggguucaccaaaaaucc

SEQ ID NO: 2200 - RNA, 23 nt, Artificial Sequence
  source: /note="Description of Artificial Sequence: Synthetic oligonucleotide"
guucaccaaaaauccaagcacaa

SEQ ID NO: 2201 - RNA, 23 nt, Artificial Sequence
  source: /note="Description of Artificial Sequence: Synthetic oligonucleotide"
uucaccaaaaauccaagcacaag

SEQ ID NO: 2202 - RNA, 23 nt, Artificial Sequence
  source: /note="Description of Artificial Sequence: Synthetic oligonucleotide"
ccaaaaauccaagcacaagauua

SEQ ID NO: 2203 - RNA, 23 nt, Artificial Sequence
  source: /note="Description of Artificial Sequence: Synthetic oligonucleotide"
caaaaauccaagcacaagauuau

SEQ ID NO: 2204 - RNA, 23 nt, Artificial Sequence
  source: /note="Description of Artificial Sequence: Synthetic oligonucleotide"
aaaaauccaagcacaagauuaug

SEQ ID NO: 2205 - RNA, 23 nt, Artificial Sequence
  source: /note="Description of Artificial Sequence: Synthetic oligonucleotide"
aauccaagcacaagauuauggcc

SEQ ID NO: 2206 - RNA, 23 nt, Artificial Sequence
  source: /note="Description of Artificial Sequence: Synthetic oligonucleotide"
caagcacaagauuauggccugua

SEQ ID NO: 2207 - RNA, 23 nt, Artificial Sequence
  source: /note="Description of Artificial Sequence: Synthetic oligonucleotide"
aagcacaagauuauggccuguau

SEQ ID NO: 2208 - RNA, 23 nt, Artificial Sequence
  source: /note="Description of Artificial Sequence: Synthetic oligonucleotide"
agcacaagauuauggccuguauu

SEQ ID NO: 2209 - RNA, 23 nt, Artificial Sequence
  source: /note="Description of Artificial Sequence: Synthetic oligonucleotide"
gcacaagauuauggccuguauug

SEQ ID NO: 2210 - RNA, 23 nt, Artificial Sequence
  source: /note="Description of Artificial Sequence: Synthetic oligonucleotide"
cacaagauuauggccuguauugg

SEQ ID NO: 2211 - RNA, 23 nt, Artificial Sequence
  source: /note="Description of Artificial Sequence: Synthetic oligonucleotide"
agauuauggccuguauuggagac

SEQ ID NO: 2212 - RNA, 23 nt, Artificial Sequence
  source: /note="Description of Artificial Sequence: Synthetic oligonucleotide"
uauggccuguauuggagacagau

SEQ ID NO: 2213 - RNA, 23 nt, Artificial Sequence
  source: /note="Description of Artificial Sequence: Synthetic oligonucleotide"
auggccuguauuggagacagaug

SEQ ID NO: 2214 - RNA, 23 nt, Artificial Sequence
  source: /note="Description of Artificial Sequence: Synthetic oligonucleotide"
uggccuguauuggagacagauga

SEQ ID NO: 2215 - RNA, 23 nt, Artificial Sequence
  source: /note="Description of Artificial Sequence: Synthetic oligonucleotide"
acagaugaagucguaagaagucu

SEQ ID NO: 2216 - RNA, 23 nt, Artificial Sequence
  source: /note="Description of Artificial Sequence: Synthetic oligonucleotide"
cagaugaagucguaagaagucug

SEQ ID NO: 2217 - RNA, 23 nt, Artificial Sequence
  source: /note="Description of Artificial Sequence: Synthetic oligonucleotide"
augaagucguaagaagucugaua

SEQ ID NO: 2218 - RNA, 23 nt, Artificial Sequence
  source: /note="Description of Artificial Sequence: Synthetic oligonucleotide"
gaagucguaagaagucugauaga

SEQ ID NO: 2219 - RNA, 23 nt, Artificial Sequence
  source: /note="Description of Artificial Sequence: Synthetic oligonucleotide"
ucguaagaagucugauagaugga

SEQ ID NO: 2220 - RNA, 23 nt, Artificial Sequence
  source: /note="Description of Artificial Sequence: Synthetic oligonucleotide"
cguaagaagucugauagauggaa

SEQ ID NO: 2221 - RNA, 23 nt, Artificial Sequence
  source: /note="Description of Artificial Sequence: Synthetic oligonucleotide"
guaagaagucugauagauggaau

SEQ ID NO: 2222 - RNA, 23 nt, Artificial Sequence
  source: /note="Description of Artificial Sequence: Synthetic oligonucleotide"
uaagaagucugauagauggaaua

SEQ ID NO: 2223 - RNA, 23 nt, Artificial Sequence
  source: /note="Description of Artificial Sequence: Synthetic oligonucleotide"
aagaagucugauagauggaauac

SEQ ID NO: 2224 - RNA, 23 nt, Artificial Sequence
  source: /note="Description of Artificial Sequence: Synthetic oligonucleotide"
agaagucugauagauggaauacu

SEQ ID NO: 2225 - RNA, 23 nt, Artificial Sequence
  source: /note="Description of Artificial Sequence: Synthetic oligonucleotide"
aagucugauagauggaauacuua

SEQ ID NO: 2226 - RNA, 23 nt, Artificial Sequence
  source: /note="Description of Artificial Sequence: Synthetic oligonucleotide"
agucugauagauggaauacuuac

SEQ ID NO: 2227 - RNA, 23 nt, Artificial Sequence
  source: /note="Description of Artificial Sequence: Synthetic oligonucleotide"
auagauggaauacuuaccaauaa

SEQ ID NO: 2228 - RNA, 23 nt, Artificial Sequence
  source: /note="Description of Artificial Sequence: Synthetic oligonucleotide"
uagauggaauacuuaccaauaag

SEQ ID NO: 2229 - RNA, 23 nt, Artificial Sequence
  source: /note="Description of Artificial Sequence: Synthetic oligonucleotide"
agauggaauacuuaccaauaaga

SEQ ID NO: 2230 - RNA, 23 nt, Artificial Sequence
  source: /note="Description of Artificial Sequence: Synthetic oligonucleotide"
gauggaauacuuaccaauaagaa

SEQ ID NO: 2231 - RNA, 23 nt, Artificial Sequence
  source: /note="Description of Artificial Sequence: Synthetic oligonucleotide"
auggaauacuuaccaauaagaaa

SEQ ID NO: 2232 - RNA, 23 nt, Artificial Sequence
  source: /note="Description of Artificial Sequence: Synthetic oligonucleotide"
uggaauacuuaccaauaagaaaa

SEQ ID NO: 2233 - RNA, 23 nt, Artificial Sequence
  source: /note="Description of Artificial Sequence: Synthetic oligonucleotide"
ggaauacuuaccaauaagaaaau

SEQ ID NO: 2234 - RNA, 23 nt, Artificial Sequence
  source: /note="Description of Artificial Sequence: Synthetic oligonucleotide"
uuguuccaucguauaucaauauc

SEQ ID NO: 2235 - RNA, 23 nt, Artificial Sequence
  source: /note="Description of Artificial Sequence: Synthetic oligonucleotide"
uguuccaucguauaucaauaucu

SEQ ID NO: 2236 - RNA, 23 nt, Artificial Sequence
  source: /note="Description of Artificial Sequence: Synthetic oligonucleotide"
guuccaucguauaucaauaucuu

SEQ ID NO: 2237 - RNA, 23 nt, Artificial Sequence
  source: /note="Description of Artificial Sequence: Synthetic oligonucleotide"
uuccaucguauaucaauaucuuu

SEQ ID NO: 2238 - RNA, 23 nt, Artificial Sequence
  source: /note="Description of Artificial Sequence: Synthetic oligonucleotide"
cuacagaaguuucuuccugaacg

SEQ ID NO: 2239 - RNA, 23 nt, Artificial Sequence
  source: /note="Description of Artificial Sequence: Synthetic oligonucleotide"
acagaaguuucuuccugaacgcg

SEQ ID NO: 2240 - RNA, 23 nt, Artificial Sequence
  source: /note="Description of Artificial Sequence: Synthetic oligonucleotide"
agaaguuucuuccugaacgcgcc

SEQ ID NO: 2241 - RNA, 23 nt, Artificial Sequence
  source: /note="Description of Artificial Sequence: Synthetic oligonucleotide"
uuucuuccugaacgcgccucagc

SEQ ID NO: 2242 - RNA, 23 nt, Artificial Sequence
  source: /note="Description of Artificial Sequence: Synthetic oligonucleotide"
gcgauuuuaaaucguaugcagaa

SEQ ID NO: 2243 - RNA, 23 nt, Artificial Sequence
  source: /note="Description of Artificial Sequence: Synthetic oligonucleotide"
cgauuuuaaaucguaugcagaau

SEQ ID NO: 2244 - RNA, 23 nt, Artificial Sequence
  source: /note="Description of Artificial Sequence: Synthetic oligonucleotide"
gauuuuaaaucguaugcagaaua

SEQ ID NO: 2245 - RNA, 23 nt, Artificial Sequence
  source: /note="Description of Artificial Sequence: Synthetic oligonucleotide"
uuaaaucguaugcagaauauuca

SEQ ID NO: 2246 - RNA, 23 nt, Artificial Sequence
  source: /note="Description of Artificial Sequence: Synthetic oligonucleotide"
aaaucguaugcagaauauucaau

SEQ ID NO: 2247 - RNA, 23 nt, Artificial Sequence
  source: /note="Description of Artificial Sequence: Synthetic oligonucleotide"
aaucguaugcagaauauucaauu

SEQ ID NO: 2248 - RNA, 23 nt, Artificial Sequence
  source: /note="Description of Artificial Sequence: Synthetic oligonucleotide"
aucguaugcagaauauucaauuu

SEQ ID NO: 2249 - RNA, 23 nt, Artificial Sequence
  source: /note="Description of Artificial Sequence: Synthetic oligonucleotide"
guaugcagaauauucaauuugaa

SEQ ID NO: 2250 - RNA, 23 nt, Artificial Sequence
  source: /note="Description of Artificial Sequence: Synthetic oligonucleotide"
augcagaauauucaauuugaagc

SEQ ID NO: 2251 - RNA, 23 nt, Artificial Sequence
  source: /note="Description of Artificial Sequence: Synthetic oligonucleotide"
agaauauucaauuugaagcagug

SEQ ID NO: 2252 - RNA, 23 nt, Artificial Sequence
  source: /note="Description of Artificial Sequence: Synthetic oligonucleotide"
aauauucaauuugaagcaguggu

SEQ ID NO: 2253 - RNA, 23 nt, Artificial Sequence
  source: /note="Description of Artificial Sequence: Synthetic oligonucleotide"
gagauguaugcaugauaaugaua

SEQ ID NO: 2254 - RNA, 23 nt, Artificial Sequence
  source: /note="Description of Artificial Sequence: Synthetic oligonucleotide"
ugaauaguuucgaaucaaugcug

SEQ ID NO: 2255 - RNA, 23 nt, Artificial Sequence
  source: /note="Description of Artificial Sequence: Synthetic oligonucleotide"
aucaaugcugcaaagcuuuauuu

SEQ ID NO: 2256 - RNA, 23 nt, Artificial Sequence
  source: /note="Description of Artificial Sequence: Synthetic oligonucleotide"
gcaaagcuuuauuucacauuuuu

SEQ ID NO: 2257 - RNA, 23 nt, Artificial Sequence
  source: /note="Description of Artificial Sequence: Synthetic oligonucleotide"
uuaaaaacauugguuuggcacua

SEQ ID NO: 2258 - RNA, 23 nt, Artificial Sequence
  source: /note="Description of Artificial Sequence: Synthetic oligonucleotide"
uaaaaacauugguuuggcacuag

SEQ ID NO: 2259 - RNA, 23 nt, Artificial Sequence
  source: /note="Description of Artificial Sequence: Synthetic oligonucleotide"
aaacgaacaagauuaauuaccug

SEQ ID NO: 2260 - RNA, 23 nt, Artificial Sequence
  source: /note="Description of Artificial Sequence: Synthetic oligonucleotide"
cgaacaagauuaauuaccugucu

SEQ ID NO: 2261 - RNA, 23 nt, Artificial Sequence
  source: /note="Description of Artificial Sequence: Synthetic oligonucleotide"
caagauuaauuaccugucuuccu

SEQ ID NO: 2262 - RNA, 23 nt, Artificial Sequence
  source: /note="Description of Artificial Sequence: Synthetic oligonucleotide"
aagauuaauuaccugucuuccug

SEQ ID NO: 2263 - RNA, 23 nt, Artificial Sequence
  source: /note="Description of Artificial Sequence: Synthetic oligonucleotide"
auuaauuaccugucuuccuguuu

SEQ ID NO: 2264 - RNA, 23 nt, Artificial Sequence
  source: /note="Description of Artificial Sequence: Synthetic oligonucleotide"
uuaauuaccugucuuccuguuuc

SEQ ID NO: 2265 - RNA, 23 nt, Artificial Sequence
  source: /note="Description of Artificial Sequence: Synthetic oligonucleotide"
uaauuaccugucuuccuguuucu

SEQ ID NO: 2266 - RNA, 23 nt, Artificial Sequence
  source: /note="Description of Artificial Sequence: Synthetic oligonucleotide"
aauuaccugucuuccuguuucuc

SEQ ID NO: 2267 - RNA, 23 nt, Artificial Sequence
  source: /note="Description of Artificial Sequence: Synthetic oligonucleotide"
auuaccugucuuccuguuucuca

SEQ ID NO: 2268 - RNA, 23 nt, Artificial Sequence
  source: /note="Description of Artificial Sequence: Synthetic oligonucleotide"
uuaccugucuuccuguuucucaa

SEQ ID NO: 2269 - RNA, 23 nt, Artificial Sequence
  source: /note="Description of Artificial Sequence: Synthetic oligonucleotide"
uaccugucuuccuguuucucaag

SEQ ID NO: 2270 - RNA, 23 nt, Artificial Sequence
  source: /note="Description of Artificial Sequence: Synthetic oligonucleotide"
uaggucuguuuuuccuuucaugc

SEQ ID NO: 2271 - RNA, 23 nt, Artificial Sequence
  source: /note="Description of Artificial Sequence: Synthetic oligonucleotide"
aggucuguuuuuccuuucaugcc

SEQ ID NO: 2272 - RNA, 23 nt, Artificial Sequence
  source: /note="Description of Artificial Sequence: Synthetic oligonucleotide"
guuuuuccuuucaugccucuuaa

SEQ ID NO: 2273 - RNA, 23 nt, Artificial Sequence
  source: /note="Description of Artificial Sequence: Synthetic oligonucleotide"
uuuccuuucaugccucuuaaaaa

SEQ ID NO: 2274 - RNA, 23 nt, Artificial Sequence
  source: /note="Description of Artificial Sequence: Synthetic oligonucleotide"
uccuuucaugccucuuaaaaacu

SEQ ID NO: 2275 - RNA, 23 nt, Artificial Sequence
  source: /note="Description of Artificial Sequence: Synthetic oligonucleotide"
uauuuuuccauuuaaagguggac

SEQ ID NO: 2276 - RNA, 23 nt, Artificial Sequence
  source: /note="Description of Artificial Sequence: Synthetic oligonucleotide"
agaacuuauuuacacagggaagg

SEQ ID NO: 2277 - RNA, 23 nt, Artificial Sequence
  source: /note="Description of Artificial Sequence: Synthetic oligonucleotide"
acuuauuuacacagggaagguuu

SEQ ID NO: 2278 - RNA, 23 nt, Artificial Sequence
  source: /note="Description of Artificial Sequence: Synthetic oligonucleotide"
uuacacagggaagguuuaagacu

SEQ ID NO: 2279 - RNA, 23 nt, Artificial Sequence
  source: /note="Description of Artificial Sequence: Synthetic oligonucleotide"
uacacagggaagguuuaagacug

SEQ ID NO: 2280 - RNA, 23 nt, Artificial Sequence
  source: /note="Description of Artificial Sequence: Synthetic oligonucleotide"
acagggaagguuuaagacuguuc

SEQ ID NO: 2281 - RNA, 23 nt, Artificial Sequence
  source: /note="Description of Artificial Sequence: Synthetic oligonucleotide"
cagggaagguuuaagacuguuca

SEQ ID NO: 2282 - RNA, 23 nt, Artificial Sequence
  source: /note="Description of Artificial Sequence: Synthetic oligonucleotide"
agggaagguuuaagacuguucaa

SEQ ID NO: 2283 - RNA, 23 nt, Artificial Sequence
  source: /note="Description of Artificial Sequence: Synthetic oligonucleotide"
gggaagguuuaagacuguucaag

SEQ ID NO: 2284 - RNA, 23 nt, Artificial Sequence
  source: /note="Description of Artificial Sequence: Synthetic oligonucleotide"
ggaagguuuaagacuguucaagu

SEQ ID NO: 2285 - RNA, 23 nt, Artificial Sequence
  source: /note="Description of Artificial Sequence: Synthetic oligonucleotide"
gaagguuuaagacuguucaagua

SEQ ID NO: 2286 - RNA, 23 nt, Artificial Sequence
  source: /note="Description of Artificial Sequence: Synthetic oligonucleotide"
aagguuuaagacuguucaaguag

SEQ ID NO: 2287 - RNA, 23 nt, Artificial Sequence
  source: /note="Description of Artificial Sequence: Synthetic oligonucleotide"
gguuuaagacuguucaaguagca

SEQ ID NO: 2288 - RNA, 23 nt, Artificial Sequence
  source: /note="Description of Artificial Sequence: Synthetic oligonucleotide"
uuuaagacuguucaaguagcauu

SEQ ID NO: 2289 - RNA, 23 nt, Artificial Sequence
  source: /note="Description of Artificial Sequence: Synthetic oligonucleotide"
uuaagacuguucaaguagcauuc

SEQ ID NO: 2290 - RNA, 23 nt, Artificial Sequence
  source: /note="Description of Artificial Sequence: Synthetic oligonucleotide"
uaagacuguucaaguagcauucc

SEQ ID NO: 2291 - RNA, 23 nt, Artificial Sequence
  source: /note="Description of Artificial Sequence: Synthetic oligonucleotide"
aagacuguucaaguagcauucca

SEQ ID NO: 2292 - RNA, 23 nt, Artificial Sequence
  source: /note="Description of Artificial Sequence: Synthetic oligonucleotide"
agacuguucaaguagcauuccaa

SEQ ID NO: 2293 - RNA, 23 nt, Artificial Sequence
  source: /note="Description of Artificial Sequence: Synthetic oligonucleotide"
gacuguucaaguagcauuccaau

SEQ ID NO: 2294 - RNA, 23 nt, Artificial Sequence
  source: /note="Description of Artificial Sequence: Synthetic oligonucleotide"
acuguucaaguagcauuccaauc

SEQ ID NO: 2295 - RNA, 23 nt, Artificial Sequence
  source: /note="Description of Artificial Sequence: Synthetic oligonucleotide"
cuguucaaguagcauuccaaucu

SEQ ID NO: 2296 - RNA, 23 nt, Artificial Sequence
  source: /note="Description of Artificial Sequence: Synthetic oligonucleotide"
uguucaaguagcauuccaaucug

SEQ ID NO: 2297 - RNA, 23 nt, Artificial Sequence
  source: /note="Description of Artificial Sequence: Synthetic oligonucleotide"
uucaaguagcauuccaaucugua

SEQ ID NO: 2298 - RNA, 23 nt, Artificial Sequence
  source: /note="Description of Artificial Sequence: Synthetic oligonucleotide"
ucaaguagcauuccaaucuguag

SEQ ID NO: 2299 - RNA, 23 nt, Artificial Sequence
  source: /note="Description of Artificial Sequence: Synthetic oligonucleotide"
guagcauuccaaucuguagccau

SEQ ID NO: 2300 - RNA, 23 nt, Artificial Sequence
  source: /note="Description of Artificial Sequence: Synthetic oligonucleotide"
cagaauaucaacaagaacacaga

SEQ ID NO: 2301 - RNA, 23 nt, Artificial Sequence
  source: /note="Description of Artificial Sequence: Synthetic oligonucleotide"
acaagaacacagaaugagugcac

SEQ ID NO: 2302 - RNA, 23 nt, Artificial Sequence
  source: /note="Description of Artificial Sequence: Synthetic oligonucleotide"
aagaacacagaaugagugcacag

SEQ ID NO: 2303 - RNA, 23 nt, Artificial Sequence
  source: /note="Description of Artificial Sequence: Synthetic oligonucleotide"
agaacacagaaugagugcacagc

SEQ ID NO: 2304 - RNA, 23 nt, Artificial Sequence
  source: /note="Description of Artificial Sequence: Synthetic oligonucleotide"
cacagaaugagugcacagcuaag

SEQ ID NO: 2305 - RNA, 23 nt, Artificial Sequence
  source: /note="Description of Artificial Sequence: Synthetic oligonucleotide"
gcaggcagcuuuaucucaaccug

SEQ ID NO: 2306 - RNA, 23 nt, Artificial Sequence
  source: /note="Description of Artificial Sequence: Synthetic oligonucleotide"
aggcagcuuuaucucaaccugga

SEQ ID NO: 2307 - RNA, 23 nt, Artificial Sequence
  source: /note="Description of Artificial Sequence: Synthetic oligonucleotide"
gauucagcauuugaaagauuucc

SEQ ID NO: 2308 - RNA, 23 nt, Artificial Sequence
  source: /note="Description of Artificial Sequence: Synthetic oligonucleotide"
ucagcauuugaaagauuucccua

SEQ ID NO: 2309 - RNA, 23 nt, Artificial Sequence
  source: /note="Description of Artificial Sequence: Synthetic oligonucleotide"
agcauuugaaagauuucccuagc

SEQ ID NO: 2310 - RNA, 23 nt, Artificial Sequence
  source: /note="Description of Artificial Sequence: Synthetic oligonucleotide"
gcauuugaaagauuucccuagcc

SEQ ID NO: 2311 - RNA, 23 nt, Artificial Sequence
  source: /note="Description of Artificial Sequence: Synthetic oligonucleotide"
uuugaaagauuucccuagccucu

SEQ ID NO: 2312 - RNA, 23 nt, Artificial Sequence
  source: /note="Description of Artificial Sequence: Synthetic oligonucleotide"
uugaaagauuucccuagccucuu

SEQ ID NO: 2313 - RNA, 23 nt, Artificial Sequence
  source: /note="Description of Artificial Sequence: Synthetic oligonucleotide"
auuucccuagccucuuccuuuuu

SEQ ID NO: 2314 - RNA, 23 nt, Artificial Sequence
  source: /note="Description of Artificial Sequence: Synthetic oligonucleotide"
ccaaaacggugcaacucuauucu

SEQ ID NO: 2315 - RNA, 23 nt, Artificial Sequence
  source: /note="Description of Artificial Sequence: Synthetic oligonucleotide"
caaaacggugcaacucuauucug

SEQ ID NO: 2316 - RNA, 23 nt, Artificial Sequence
  source: /note="Description of Artificial Sequence: Synthetic oligonucleotide"
aaaacggugcaacucuauucugg

SEQ ID NO: 2317 - RNA, 23 nt, Artificial Sequence
  source: /note="Description of Artificial Sequence: Synthetic oligonucleotide"
acggugcaacucuauucuggacu

SEQ ID NO: 2318 - RNA, 23 nt, Artificial Sequence
  source: /note="Description of Artificial Sequence: Synthetic oligonucleotide"
cggugcaacucuauucuggacuu

SEQ ID NO: 2319 - RNA, 23 nt, Artificial Sequence
  source: /note="Description of Artificial Sequence: Synthetic oligonucleotide"
ggugcaacucuauucuggacuuu

SEQ ID NO: 2320 - RNA, 23 nt, Artificial Sequence
  source: /note="Description of Artificial Sequence: Synthetic oligonucleotide"
gugcaacucuauucuggacuuua

SEQ ID NO: 2321 - RNA, 23 nt, Artificial Sequence
  source: /note="Description of Artificial Sequence: Synthetic oligonucleotide"
ugcaacucuauucuggacuuuau

SEQ ID NO: 2322 - RNA, 23 nt, Artificial Sequence
  source: /note="Description of Artificial Sequence: Synthetic oligonucleotide"
gcaacucuauucuggacuuuauu

SEQ ID NO: 2323 - RNA, 23 nt, Artificial Sequence
  source: /note="Description of Artificial Sequence: Synthetic oligonucleotide"
caacucuauucuggacuuuauua

SEQ ID NO: 2324 - RNA, 23 nt, Artificial Sequence
  source: /note="Description of Artificial Sequence: Synthetic oligonucleotide"
aacucuauucuggacuuuauuac

SEQ ID NO: 2325 - RNA, 23 nt, Artificial Sequence
  source: /note="Description of Artificial Sequence: Synthetic oligonucleotide"
ucuauucuggacuuuauuacuug

SEQ ID NO: 2326 - RNA, 23 nt, Artificial Sequence
  source: /note="Description of Artificial Sequence: Synthetic oligonucleotide"
cuauucuggacuuuauuacuuga

SEQ ID NO: 2327 - RNA, 23 nt, Artificial Sequence
  source: /note="Description of Artificial Sequence: Synthetic oligonucleotide"
uauucuggacuuuauuacuugau

SEQ ID NO: 2328 - RNA, 23 nt, Artificial Sequence
  source: /note="Description of Artificial Sequence: Synthetic oligonucleotide"
ucugaaguccaccaaaaguggac

SEQ ID NO: 2329 - RNA, 23 nt, Artificial Sequence
  source: /note="Description of Artificial Sequence: Synthetic oligonucleotide"
caccaaaaguggacccucuauau

SEQ ID NO: 2330 - RNA, 23 nt, Artificial Sequence
  source: /note="Description of Artificial Sequence: Synthetic oligonucleotide"
accaaaaguggacccucuauauu

SEQ ID NO: 2331 - RNA, 23 nt, Artificial Sequence
  source: /note="Description of Artificial Sequence: Synthetic oligonucleotide"
caaaaguggacccucuauauuuc

SEQ ID NO: 2332 - RNA, 23 nt, Artificial Sequence
  source: /note="Description of Artificial Sequence: Synthetic oligonucleotide"
aaaaguggacccucuauauuucc

SEQ ID NO: 2333 - RNA, 23 nt, Artificial Sequence
  source: /note="Description of Artificial Sequence: Synthetic oligonucleotide"
ugcuuucauauauccuugguccc

SEQ ID NO: 2334 - RNA, 23 nt, Artificial Sequence
  source: /note="Description of Artificial Sequence: Synthetic oligonucleotide"
cuuucauauauccuuggucccag

SEQ ID NO: 2335 - RNA, 23 nt, Artificial Sequence
  source: /note="Description of Artificial Sequence: Synthetic oligonucleotide"
gagauguuuagacaauuuuaggc

SEQ ID NO: 2336 - RNA, 23 nt, Artificial Sequence
  source: /note="Description of Artificial Sequence: Synthetic oligonucleotide"
agauguuuagacaauuuuaggcu

SEQ ID NO: 2337 - RNA, 23 nt, Artificial Sequence
  source: /note="Description of Artificial Sequence: Synthetic oligonucleotide"
auguuuagacaauuuuaggcuca

SEQ ID NO: 2338 - RNA, 23 nt, Artificial Sequence
  source: /note="Description of Artificial Sequence: Synthetic oligonucleotide"
uguuuagacaauuuuaggcucaa

SEQ ID NO: 2339 - RNA, 23 nt, Artificial Sequence
  source: /note="Description of Artificial Sequence: Synthetic oligonucleotide"
guuuagacaauuuuaggcucaaa

SEQ ID NO: 2340 - RNA, 23 nt, Artificial Sequence
  source: /note="Description of Artificial Sequence: Synthetic oligonucleotide"
uuuagacaauuuuaggcucaaaa

SEQ ID NO: 2341 - RNA, 23 nt, Artificial Sequence
  source: /note="Description of Artificial Sequence: Synthetic oligonucleotide"
uagacaauuuuaggcucaaaaau

SEQ ID NO: 2342 - RNA, 23 nt, Artificial Sequence
  source: /note="Description of Artificial Sequence: Synthetic oligonucleotide"
uuuuaggcucaaaaauuaaagcu

SEQ ID NO: 2343 - RNA, 23 nt, Artificial Sequence
  source: /note="Description of Artificial Sequence: Synthetic oligonucleotide"
uuuaggcucaaaaauuaaagcua

SEQ ID NO: 2344 - RNA, 23 nt, Artificial Sequence
  source: /note="Description of Artificial Sequence: Synthetic oligonucleotide"
uuaggcucaaaaauuaaagcuaa

SEQ ID NO: 2345 - RNA, 23 nt, Artificial Sequence
  source: /note="Description of Artificial Sequence: Synthetic oligonucleotide"
uaggcucaaaaauuaaagcuaac

SEQ ID NO: 2346 - RNA, 23 nt, Artificial Sequence
  source: /note="Description of Artificial Sequence: Synthetic oligonucleotide"
aggcucaaaaauuaaagcuaaca

SEQ ID NO: 2347 - RNA, 23 nt, Artificial Sequence
  source: /note="Description of Artificial Sequence: Synthetic oligonucleotide"
ggcucaaaaauuaaagcuaacac

SEQ ID NO: 2348 - RNA, 23 nt, Artificial Sequence
  source: /note="Description of Artificial Sequence: Synthetic oligonucleotide"
gcucaaaaauuaaagcuaacaca

SEQ ID NO: 2349 - RNA, 23 nt, Artificial Sequence
  source: /note="Description of Artificial Sequence: Synthetic oligonucleotide"
cucaaaaauuaaagcuaacacag

SEQ ID NO: 2350 - RNA, 23 nt, Artificial Sequence
  source: /note="Description of Artificial Sequence: Synthetic oligonucleotide"
aaaaauuaaagcuaacacaggaa

SEQ ID NO: 2351 - RNA, 23 nt, Artificial Sequence
  source: /note="Description of Artificial Sequence: Synthetic oligonucleotide"
aaagcuaacacaggaaaaggaac

SEQ ID NO: 2352 - RNA, 23 nt, Artificial Sequence
  source: /note="Description of Artificial Sequence: Synthetic oligonucleotide"
gcuaacacaggaaaaggaacugu

SEQ ID NO: 2353 - RNA, 23 nt, Artificial Sequence
  source: /note="Description of Artificial Sequence: Synthetic oligonucleotide"
aacacaggaaaaggaacuguacu

SEQ ID NO: 2354 - RNA, 23 nt, Artificial Sequence
  source: /note="Description of Artificial Sequence: Synthetic oligonucleotide"
cacaggaaaaggaacuguacugg

SEQ ID NO: 2355 - RNA, 23 nt, Artificial Sequence
  source: /note="Description of Artificial Sequence: Synthetic oligonucleotide"
aaaggaacuguacuggcuauuac

SEQ ID NO: 2356 - RNA, 23 nt, Artificial Sequence
  source: /note="Description of Artificial Sequence: Synthetic oligonucleotide"
aaggaacuguacuggcuauuaca

SEQ ID NO: 2357 - RNA, 23 nt, Artificial Sequence
  source: /note="Description of Artificial Sequence: Synthetic oligonucleotide"
uccgacucccacuacaucaagac

SEQ ID NO: 2358 - RNA, 23 nt, Artificial Sequence
  source: /note="Description of Artificial Sequence: Synthetic oligonucleotide"
gacucccacuacaucaagacuaa

SEQ ID NO: 2359 - RNA, 23 nt, Artificial Sequence
  source: /note="Description of Artificial Sequence: Synthetic oligonucleotide"
acucccacuacaucaagacuaau

SEQ ID NO: 2360 - RNA, 23 nt, Artificial Sequence
  source: /note="Description of Artificial Sequence: Synthetic oligonucleotide"
cucccacuacaucaagacuaauc

SEQ ID NO: 2361 - RNA, 23 nt, Artificial Sequence
  source: /note="Description of Artificial Sequence: Synthetic oligonucleotide"
ucccacuacaucaagacuaaucu

SEQ ID NO: 2362 - RNA, 23 nt, Artificial Sequence
  source: /note="Description of Artificial Sequence: Synthetic oligonucleotide"
cccacuacaucaagacuaaucuu

SEQ ID NO: 2363 - RNA, 23 nt, Artificial Sequence
  source: /note="Description of Artificial Sequence: Synthetic oligonucleotide"
ccacuacaucaagacuaaucuug

SEQ ID NO: 2364 - RNA, 23 nt, Artificial Sequence
  source: /note="Description of Artificial Sequence: Synthetic oligonucleotide"
cacuacaucaagacuaaucuugu

SEQ ID NO: 2365 - RNA, 23 nt, Artificial Sequence
  source: /note="Description of Artificial Sequence: Synthetic oligonucleotide"
acuacaucaagacuaaucuuguu

SEQ ID NO: 2366 - RNA, 23 nt, Artificial Sequence
  source: /note="Description of Artificial Sequence: Synthetic oligonucleotide"
cuacaucaagacuaaucuuguuu

SEQ ID NO: 2367 - RNA, 23 nt, Artificial Sequence
  source: /note="Description of Artificial Sequence: Synthetic oligonucleotide"
uuuuguguguuuuucacauguau

SEQ ID NO: 2368 - RNA, 23 nt, Artificial Sequence
  source: /note="Description of Artificial Sequence: Synthetic oligonucleotide"
guguguuuuucacauguauuaua

SEQ ID NO: 2369 - RNA, 23 nt, Artificial Sequence
  source: /note="Description of Artificial Sequence: Synthetic oligonucleotide"
uuucacauguauuauagaaugcu

SEQ ID NO: 2370 - RNA, 23 nt, Artificial Sequence
  source: /note="Description of Artificial Sequence: Synthetic oligonucleotide"
uucacauguauuauagaaugcuu

SEQ ID NO: 2371 - RNA, 23 nt, Artificial Sequence
  source: /note="Description of Artificial Sequence: Synthetic oligonucleotide"
cauguauuauagaaugcuuuugc

SEQ ID NO: 2372 - RNA, 23 nt, Artificial Sequence
  source: /note="Description of Artificial Sequence: Synthetic oligonucleotide"
auguauuauagaaugcuuuugca

SEQ ID NO: 2373 - RNA, 23 nt, Artificial Sequence
  source: /note="Description of Artificial Sequence: Synthetic oligonucleotide"
auuauagaaugcuuuugcaugga

SEQ ID NO: 2374 - RNA, 23 nt, Artificial Sequence
  source: /note="Description of Artificial Sequence: Synthetic oligonucleotide"
auagaaugcuuuugcauggacua

SEQ ID NO: 2375 - RNA, 23 nt, Artificial Sequence
  source: /note="Description of Artificial Sequence: Synthetic oligonucleotide"
uagaaugcuuuugcauggacuau

SEQ ID NO: 2376 - RNA, 23 nt, Artificial Sequence
  source: /note="Description of Artificial Sequence: Synthetic oligonucleotide"
gaaugcuuuugcauggacuaucc

SEQ ID NO: 2377 - RNA, 23 nt, Artificial Sequence
  source: /note="Description of Artificial Sequence: Synthetic oligonucleotide"
ugcuuuugcauggacuauccucu

SEQ ID NO: 2378 - RNA, 23 nt, Artificial Sequence
  source: /note="Description of Artificial Sequence: Synthetic oligonucleotide"
uuuugcauggacuauccucuugu

SEQ ID NO: 2379 - RNA, 23 nt, Artificial Sequence
  source: /note="Description of Artificial Sequence: Synthetic oligonucleotide"
uuugcauggacuauccucuuguu

SEQ ID NO: 2380 - RNA, 23 nt, Artificial Sequence
  source: /note="Description of Artificial Sequence: Synthetic oligonucleotide"
uugcauggacuauccucuuguuu

SEQ ID NO: 2381 - RNA, 23 nt, Artificial Sequence
  source: /note="Description of Artificial Sequence: Synthetic oligonucleotide"
ugcauggacuauccucuuguuuu

SEQ ID NO: 2382 - RNA, 23 nt, Artificial Sequence
  source: /note="Description of Artificial Sequence: Synthetic oligonucleotide"
gcauggacuauccucuuguuuuu

SEQ ID NO: 2383 - RNA, 23 nt, Artificial Sequence
  source: /note="Description of Artificial Sequence: Synthetic oligonucleotide"
cauggacuauccucuuguuuuua

SEQ ID NO: 2384 - RNA, 23 nt, Artificial Sequence
  source: /note="Description of Artificial Sequence: Synthetic oligonucleotide"
auggacuauccucuuguuuuuau

SEQ ID NO: 2385 - RNA, 23 nt, Artificial Sequence
  source: /note="Description of Artificial Sequence: Synthetic oligonucleotide"
uggacuauccucuuguuuuuauu

SEQ ID NO: 2386 - RNA, 23 nt, Artificial Sequence
  source: /note="Description of Artificial Sequence: Synthetic oligonucleotide"
gacuauccucuuguuuuuauuaa

SEQ ID NO: 2387 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacaaggactgaaccagaau

SEQ ID NO: 2388 - DNA, 21 bp, Artificial Sequence
  source: /note="Description of Artificial Sequence: Synthetic oligonucleotide"
acaaggactgaaccagaagga

SEQ ID NO: 2389 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuucugcutcugaucacca

SEQ ID NO: 2390 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucugatcaccaucauu

SEQ ID NO: 2391 - RNA, 21 nt, Artificial Sequence
  source: /note="Description of Artificial Sequence: Synthetic oligonucleotide"
ucugaucaccaucaucuacuu

SEQ ID NO: 2392 - RNA, 21 nt, Artificial Sequence
  source: /note="Description of Artificial Sequence: Synthetic oligonucleotide"
accaucaucuacuccuacuuu

SEQ ID NO: 2393 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucauctacuccuacuugu

SEQ ID NO: 2394 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaucuactccuacuugga

SEQ ID NO: 2395 - RNA, 21 nt, Artificial Sequence
  source: /note="Description of Artificial Sequence: Synthetic oligonucleotide"
aucaucuacuccuacuuggau

SEQ ID NO: 2396 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuacucctacuuggaguu

SEQ ID NO: 2397 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuacucctacuuggagucgu

SEQ ID NO: 2398 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacuccuactuggagucguu

SEQ ID NO: 2399 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacuccuacutggagucguuu

SEQ ID NO: 2400 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccuactuggagucguugu

SEQ ID NO: 2401 - skipped

SEQ ID NO: 2402 - RNA, 21 nt, Artificial Sequence
  source: /note="Description of Artificial Sequence: Synthetic oligonucleotide"
uccuacuuggagucguugguu

SEQ ID NO: 2403 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucguuggtgaaguuuuucau

SEQ ID NO: 2404 - RNA, 21 nt, Artificial Sequence
  source: /note="Description of Artificial Sequence: Synthetic oligonucleotide"
uugguucugugggauauuaau

SEQ ID NO: 2405 - RNA, 21 nt, Artificial Sequence
  source: /note="Description of Artificial Sequence: Synthetic oligonucleotide"
guucugugggauauuaauaau

SEQ ID NO: 2406 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugggatatuaauaagcgu

SEQ ID NO: 2407 - RNA, 21 nt, Artificial Sequence
  source: /note="Description of Artificial Sequence: Synthetic oligonucleotide"
gcugagugccgaaaacuaggu

SEQ ID NO: 2408 - RNA, 21 nt, Artificial Sequence
  source: /note="Description of Artificial Sequence: Synthetic oligonucleotide"
cugagugccgaaaacuaggcu

SEQ ID NO: 2409 - RNA, 21 nt, Artificial Sequence
  source: /note="Description of Artificial Sequence: Synthetic oligonucleotide"
gagugccgaaaacuaggcguu

SEQ ID NO: 2410 - RNA, 21 nt, Artificial Sequence
  source: /note="Description of Artificial Sequence: Synthetic oligonucleotide"
agugccgaaaacuaggcguca

SEQ ID NO: 2411 - RNA, 21 nt, Artificial Sequence
  source: /note="Description of Artificial Sequence: Synthetic oligonucleotide"
gugccgaaaacuaggcgucau

SEQ ID NO: 2412 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgaaaactaggcgucacu

SEQ ID NO: 2413 - RNA, 21 nt, Artificial Sequence
  source: /note="Description of Artificial Sequence: Synthetic oligonucleotide"
gccgaaaacuaggcgucacuu

SEQ ID NO: 2414 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgaaaactaggcgucacugu

SEQ ID NO: 2415 - RNA, 21 nt, Artificial Sequence
  source: /note="Description of Artificial Sequence: Synthetic oligonucleotide"
cagagaagagaucuaucgcuu

SEQ ID NO: 2416 - RNA, 21 nt, Artificial Sequence
  source: /note="Description of Artificial Sequence: Synthetic oligonucleotide"
agagaucuaucgcucucuaaa

SEQ ID NO: 2417 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaucuatcgcucucuaaau

SEQ ID NO: 2418 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuaucgctcucuaaauca

SEQ ID NO: 2419 - RNA, 21 nt, Artificial Sequence
  source: /note="Description of Artificial Sequence: Synthetic oligonucleotide"
aucuaucgcucucuaaaucau

SEQ ID NO: 2420 - RNA, 21 nt, Artificial Sequence
  source: /note="Description of Artificial Sequence: Synthetic oligonucleotide"
cuaucgcucucuaaaucaggu

SEQ ID NO: 2421 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucgcuctctaaaucagguu

SEQ ID NO: 2422 - skipped

SEQ ID NO: 2423 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcucuctaaaucaggugaa

SEQ ID NO: 2424 - RNA, 21 nt, Artificial Sequence
  source: /note="Description of Artificial Sequence: Synthetic oligonucleotide"
cgcucucuaaaucaggugaau

SEQ ID NO: 2425 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuaaatcaggugaagaaa

SEQ ID NO: 2426 - RNA, 21 nt, Artificial Sequence
  source: /note="Description of Artificial Sequence: Synthetic oligonucleotide"
augcugggacaguauauccau

SEQ ID NO: 2427 - RNA, 21 nt, Artificial Sequence
  source: /note="Description of Artificial Sequence: Synthetic oligonucleotide"
ugcugggacaguauauccagu

SEQ ID NO: 2428 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacaguatatccagccgauu

SEQ ID NO: 2429 - RNA, 21 nt, Artificial Sequence
  source: /note="Description of Artificial Sequence: Synthetic oligonucleotide"
caguauauccagccgaucuuu

SEQ ID NO: 2430 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaaggatgaagagauuacu

SEQ ID NO: 2431 - RNA, 21 nt, Artificial Sequence
  source: /note="Description of Artificial Sequence: Synthetic oligonucleotide"
ccaaggaugaagagauuacca

SEQ ID NO: 2432 - RNA, 21 nt, Artificial Sequence
  source: /note="Description of Artificial Sequence: Synthetic oligonucleotide"
caaggaugaagagauuaccaa

SEQ ID NO: 2433 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaagacatutgaggucaaca

SEQ ID NO: 2434 - RNA, 21 nt, Artificial Sequence
  source: /note="Description of Artificial Sequence: Synthetic oligonucleotide"
agacauuugaggucaacaucu

SEQ ID NO: 2435 - RNA, 21 nt, Artificial Sequence
  source: /note="Description of Artificial Sequence: Synthetic oligonucleotide"
gacauuugaggucaacauccu

SEQ ID NO: 2436 - RNA, 21 nt, Artificial Sequence
  source: /note="Description of Artificial Sequence: Synthetic oligonucleotide"
cauuugaggucaacauccuau

SEQ ID NO: 2437 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuugaggtcaacauccuagu

SEQ ID NO: 2438 - RNA, 21 nt, Artificial Sequence
  source: /note="Description of Artificial Sequence: Synthetic oligonucleotide"
uuugaggucaacauccuagga

SEQ ID NO: 2439 - RNA, 21 nt, Artificial Sequence
  source: /note="Description of Artificial Sequence: Synthetic oligonucleotide"
ugaggucaacauccuaggaca

SEQ ID NO: 2440 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggucaacatccuaggacau

SEQ ID NO: 2441 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucaacatccuaggacauuu

SEQ ID NO: 2442 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaacaucctaggacauuuu

SEQ ID NO: 2443 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacaucctaggacauuuuug

SEQ ID NO: 2444 - RNA, 21 nt, Artificial Sequence
  source: /note="Description of Artificial Sequence: Synthetic oligonucleotide"
aacauccuaggacauuuuugu

SEQ ID NO: 2445 - RNA, 21 nt, Artificial Sequence
  source: /note="Description of Artificial Sequence: Synthetic oligonucleotide"
acauccuaggacauuuuugga

SEQ ID NO: 2446 - RNA, 21 nt, Artificial Sequence
  source: /note="Description of Artificial Sequence: Synthetic oligonucleotide"
cauccuaggacauuuuuggau

SEQ ID NO: 2447 - RNA, 21 nt, Artificial Sequence
  source: /note="Description of Artificial Sequence: Synthetic oligonucleotide"
auccuaggacauuuuuggauu

SEQ ID NO: 2448 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuaggacatuuuuggauca

SEQ ID NO: 2449 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaggacautuuuggaucau

SEQ ID NO: 2450 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacauututggaucacaaa

SEQ ID NO: 2451 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacauuutuggaucacaaaa

SEQ ID NO: 2452 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacauuuutggaucacaaaau

SEQ ID NO: 2453 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuggatcacaaaagcacu

SEQ ID NO: 2454 - RNA, 21 nt, Artificial Sequence
  source: /note="Description of Artificial Sequence: Synthetic oligonucleotide"
uuggaucacaaaagcacuucu

SEQ ID NO: 2455 - RNA, 21 nt, Artificial Sequence
  source: /note="Description of Artificial Sequence: Synthetic oligonucleotide"
uggaucacaaaagcacuucuu

SEQ ID NO: 2456 - RNA, 21 nt, Artificial Sequence
  source: /note="Description of Artificial Sequence: Synthetic oligonucleotide"
ggaucacaaaagcacuucuuu

SEQ ID NO: 2457 - RNA, 21 nt, Artificial Sequence
  source: /note="Description of Artificial Sequence: Synthetic oligonucleotide"
cacaaaagcacuucuuccauu

SEQ ID NO: 2458 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaaagcactucuuccaucu

SEQ ID NO: 2459 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaagcacutcuuccaucga

SEQ ID NO: 2460 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagcactucuuccaucgau

SEQ ID NO: 2461 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcacutctuccaucgauu

SEQ ID NO: 2462 - skipped

SEQ ID NO: 2463 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacuuctuccaucgaugau

SEQ ID NO: 2464 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacuucutccaucgaugauu

SEQ ID NO: 2465 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaaucatggccacaucguu

SEQ ID NO: 2466 - RNA, 21 nt, Artificial Sequence
  source: /note="Description of Artificial Sequence: Synthetic oligonucleotide"
uuccuuaccucaucccauauu

SEQ ID NO: 2467 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuuacctcaucccauauuu

SEQ ID NO: 2468 - RNA, 21 nt, Artificial Sequence
  source: /note="Description of Artificial Sequence: Synthetic oligonucleotide"
accucaucccauauuguucca

SEQ ID NO: 2469 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucccatatuguuccagca

SEQ ID NO: 2470 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccauautgtuccagcaaau

SEQ ID NO: 2471 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccauauugutccagcaaauu

SEQ ID NO: 2472 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuggcutucacagaggucu

SEQ ID NO: 2473 - RNA, 21 nt, Artificial Sequence
  source: /note="Description of Artificial Sequence: Synthetic oligonucleotide"
gcuuucacagaggucugacau

SEQ ID NO: 2474 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacagaggtcugacaucau

SEQ ID NO: 2475 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacagaggtctgacaucagaa

SEQ ID NO: 2476 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucugacatcagaacuuca

SEQ ID NO: 2477 - RNA, 21 nt, Artificial Sequence
  source: /note="Description of Artificial Sequence: Synthetic oligonucleotide"
uugggaaaaacugguaucaaa

SEQ ID NO: 2478 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacugguatcaaaaccucauu

SEQ ID NO: 2479 - RNA, 21 nt, Artificial Sequence
  source: /note="Description of Artificial Sequence: Synthetic oligonucleotide"
acugguaucaaaaccucaugu

SEQ ID NO: 2480 - RNA, 21 nt, Artificial Sequence
  source: /note="Description of Artificial Sequence: Synthetic oligonucleotide"
cugguaucaaaaccucauguu

SEQ ID NO: 2481 - RNA, 21 nt, Artificial Sequence
  source: /note="Description of Artificial Sequence: Synthetic oligonucleotide"
ugguaucaaaaccucaugucu

SEQ ID NO: 2482 - RNA, 21 nt, Artificial Sequence
  source: /note="Description of Artificial Sequence: Synthetic oligonucleotide"
gguaucaaaaccucaugucuu

SEQ ID NO: 2483 - RNA, 21 nt, Artificial Sequence
  source: /note="Description of Artificial Sequence: Synthetic oligonucleotide"
guaucaaaaccucaugucucu

SEQ ID NO: 2484 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaaacctcaugucucugcu

SEQ ID NO: 2485 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugcccagtuuuugugaau

SEQ ID NO: 2486 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccaguuutugugaauacugu

SEQ ID NO: 2487 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuugugaatacuggguuca

SEQ ID NO: 2488 - RNA, 21 nt, Artificial Sequence
  source: /note="Description of Artificial Sequence: Synthetic oligonucleotide"
uuuugugaauacuggguucau

SEQ ID NO: 2489 - RNA, 21 nt, Artificial Sequence
  source: /note="Description of Artificial Sequence: Synthetic oligonucleotide"
ugugaauacuggguucaccaa

SEQ ID NO: 2490 - RNA, 21 nt, Artificial Sequence
  source: /note="Description of Artificial Sequence: Synthetic oligonucleotide"
ugaauacuggguucaccaaaa

SEQ ID NO: 2491 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauacugggtucaccaaaaa

SEQ ID NO: 2492 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauacugggutcaccaaaaau

SEQ ID NO: 2493 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacugggtucaccaaaaauu

SEQ ID NO: 2494 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacugggutcaccaaaaaucu

SEQ ID NO: 2495 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccaaaaatccaagcacaa

SEQ ID NO: 2496 - RNA, 21 nt, Artificial Sequence
  source: /note="Description of Artificial Sequence: Synthetic oligonucleotide"
caccaaaaauccaagcacaau

SEQ ID NO: 2497 - RNA, 21 nt, Artificial Sequence
  source: /note="Description of Artificial Sequence: Synthetic oligonucleotide"
aaaaauccaagcacaagauua

SEQ ID NO: 2498 - RNA, 21 nt, Artificial Sequence
  source: /note="Description of Artificial Sequence: Synthetic oligonucleotide"
aaaauccaagcacaagauuau

SEQ ID NO: 2499 - RNA, 21 nt, Artificial Sequence
  source: /note="Description of Artificial Sequence: Synthetic oligonucleotide"
aaauccaagcacaagauuauu

SEQ ID NO: 2500 - RNA, 21 nt, Artificial Sequence
  source: /note="Description of Artificial Sequence: Synthetic oligonucleotide"
uccaagcacaagauuauggcu

SEQ ID NO: 2501 - skipped

SEQ ID NO: 2502 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacaagatuauggccuguau

SEQ ID NO: 2503 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaagautatggccuguauu

SEQ ID NO: 2504 - RNA, 21 nt, Artificial Sequence
  source: /note="Description of Artificial Sequence: Synthetic oligonucleotide"
acaagauuauggccuguauuu

SEQ ID NO: 2505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagauuatggccuguauugu

SEQ ID NO: 2506 - RNA, 21 nt, Artificial Sequence
  source: /note="Description of Artificial Sequence: Synthetic oligonucleotide"
auuauggccuguauuggagau

SEQ ID NO: 2507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccuguautggagacagau

SEQ ID NO: 2508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccuguatuggagacagauu

SEQ ID NO: 2509 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuguautggagacagauga

SEQ ID NO: 2510 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugaagtcguaagaagucu

SEQ ID NO: 2511 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugaagucgtaagaagucuu

SEQ ID NO: 2512 - RNA, 21 nt, Artificial Sequence
  source: /note="Description of Artificial Sequence: Synthetic oligonucleotide"
gaagucguaagaagucugaua

SEQ ID NO: 2513 - RNA, 21 nt, Artificial Sequence
  source: /note="Description of Artificial Sequence: Synthetic oligonucleotide"
agucguaagaagucugauaga

SEQ ID NO: 2514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaagaagtctgauagaugga

SEQ ID NO: 2515 - RNA, 21 nt, Artificial Sequence
  source: /note="Description of Artificial Sequence: Synthetic oligonucleotide"
uaagaagucugauagauggaa

SEQ ID NO: 2516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaguctgauagauggaau

SEQ ID NO: 2517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagucugatagauggaaua

SEQ ID NO: 2518 - RNA, 21 nt, Artificial Sequence
  source: /note="Description of Artificial Sequence: Synthetic oligonucleotide"
gaagucugauagauggaauau

SEQ ID NO: 2519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucugatagauggaauacu

SEQ ID NO: 2520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucugauagatggaauacuua

SEQ ID NO: 2521 - RNA, 21 nt, Artificial Sequence
  source: /note="Description of Artificial Sequence: Synthetic oligonucleotide"
ucugauagauggaauacuuau

SEQ ID NO: 2522 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauggaatacuuaccaauaa

SEQ ID NO: 2523 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauggaauactuaccaauaau

SEQ ID NO: 2524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaauacutaccaauaaga

SEQ ID NO: 2525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaauactuaccaauaagaa

SEQ ID NO: 2526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaauacutaccaauaagaaa

SEQ ID NO: 2527 - RNA, 21 nt, Artificial Sequence
  source: /note="Description of Artificial Sequence: Synthetic oligonucleotide"
gaauacuuaccaauaagaaaa

SEQ ID NO: 2528 - RNA, 21 nt, Artificial Sequence
  source: /note="Description of Artificial Sequence: Synthetic oligonucleotide"
aauacuuaccaauaagaaaau

SEQ ID NO: 2529 - RNA, 21 nt, Artificial Sequence
  source: /note="Description of Artificial Sequence: Synthetic oligonucleotide"
guuccaucguauaucaauauu

SEQ ID NO: 2530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaucgtataucaauaucu

SEQ ID NO: 2531 - RNA, 21 nt, Artificial Sequence
  source: /note="Description of Artificial Sequence: Synthetic oligonucleotide"
uccaucguauaucaauaucuu

SEQ ID NO: 2532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucguatatcaauaucuuu

SEQ ID NO: 2533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagaagutucuuccugaacu

SEQ ID NO: 2534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaguuucutccugaacgcu

SEQ ID NO: 2535 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguuucutccugaacgcgcu

SEQ ID NO: 2536 - RNA, 21 nt, Artificial Sequence
  source: /note="Description of Artificial Sequence: Synthetic oligonucleotide"
ucuuccugaacgcgccucagu

SEQ ID NO: 2537 - RNA, 21 nt, Artificial Sequence
  source: /note="Description of Artificial Sequence: Synthetic oligonucleotide"
gauuuuaaaucguaugcagaa

SEQ ID NO: 2538 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuaaatcguaugcagaau

SEQ ID NO: 2539 - skipped

SEQ ID NO: 2540 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucguatgcagaauauuca

SEQ ID NO: 2541 - RNA, 21 nt, Artificial Sequence
  source: /note="Description of Artificial Sequence: Synthetic oligonucleotide"
aucguaugcagaauauucaau

SEQ ID NO: 2542 - RNA, 21 nt, Artificial Sequence
  source: /note="Description of Artificial Sequence: Synthetic oligonucleotide"
ucguaugcagaauauucaauu

SEQ ID NO: 2543 - RNA, 21 nt, Artificial Sequence
  source: /note="Description of Artificial Sequence: Synthetic oligonucleotide"
cguaugcagaauauucaauuu

SEQ ID NO: 2544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcagaatatucaauuugaa

SEQ ID NO: 2545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagaauatucaauuugaagu

SEQ ID NO: 2546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauauucaautugaagcaguu

SEQ ID NO: 2547 - skipped

SEQ ID NO: 2548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauguaugcatgauaaugaua

SEQ ID NO: 2549 - RNA, 21 nt, Artificial Sequence
  source: /note="Description of Artificial Sequence: Synthetic oligonucleotide"
aauaguuucgaaucaaugcuu

SEQ ID NO: 2550 - RNA, 21 nt, Artificial Sequence
  source: /note="Description of Artificial Sequence: Synthetic oligonucleotide"
caaugcugcaaagcuuuauuu

SEQ ID NO: 2551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcuuuautucacauuuuu

SEQ ID NO: 2552 - skipped

SEQ ID NO: 2553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacauuggtuuggcacuau

SEQ ID NO: 2554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaacaagatuaauuaccuu

SEQ ID NO: 2555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaagautaauuaccugucu

SEQ ID NO: 2556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauuaautaccugucuuccu

SEQ ID NO: 2557 - RNA, 21 nt, Artificial Sequence
  source: /note="Description of Artificial Sequence: Synthetic oligonucleotide"
gauuaauuaccugucuuccuu

SEQ ID NO: 2558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauuacctgtcuuccuguuu

SEQ ID NO: 2559 - RNA, 21 nt, Artificial Sequence
  source: /note="Description of Artificial Sequence: Synthetic oligonucleotide"
aauuaccugucuuccuguuuc

SEQ ID NO: 2560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaccugtctuccuguuucu

SEQ ID NO: 2561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaccugucutccuguuucuu

SEQ ID NO: 2562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuguctuccuguuucuca

SEQ ID NO: 2563 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugucutccuguuucucaa

SEQ ID NO: 2564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugucuucctguuucucaau

SEQ ID NO: 2565 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucuguututccuuucaugu

SEQ ID NO: 2566 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuguuutuccuuucaugcu

SEQ ID NO: 2567 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuccuutcaugccucuuaa

SEQ ID NO: 2568 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuuucatgccucuuaaaaa

SEQ ID NO: 2569 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucaugcctcuuaaaaacu

SEQ ID NO: 2570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuccatutaaagguggau

SEQ ID NO: 2571 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuuauutacacagggaagu

SEQ ID NO: 2572 - RNA, 21 nt, Artificial Sequence
  source: /note="Description of Artificial Sequence: Synthetic oligonucleotide"
uuauuuacacagggaagguuu

SEQ ID NO: 2573 - RNA, 21 nt, Artificial Sequence
  source: /note="Description of Artificial Sequence: Synthetic oligonucleotide"
acacagggaagguuuaagacu

SEQ ID NO: 2574 - RNA, 21 nt, Artificial Sequence
  source: /note="Description of Artificial Sequence: Synthetic oligonucleotide"
cacagggaagguuuaagacuu

SEQ ID NO: 2575 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggaaggtutaagacuguuu

SEQ ID NO: 2576 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaaggutuaagacuguuca

SEQ ID NO: 2577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagguutaagacuguucaa

SEQ ID NO: 2578 - RNA, 21 nt, Artificial Sequence
  source: /note="Description of Artificial Sequence: Synthetic oligonucleotide"
gaagguuuaagacuguucaau

SEQ ID NO: 2579 - RNA, 21 nt, Artificial Sequence
  source: /note="Description of Artificial Sequence: Synthetic oligonucleotide"
aagguuuaagacuguucaagu

SEQ ID NO: 2580 - RNA, 21 nt, Artificial Sequence
  source: /note="Description of Artificial Sequence: Synthetic oligonucleotide"
agguuuaagacuguucaagua

SEQ ID NO: 2581 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuuaagactguucaaguau

SEQ ID NO: 2582 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaagactgtucaaguagca

SEQ ID NO: 2583 - skipped

SEQ ID NO: 2584 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacugutcaaguagcauuu

SEQ ID NO: 2585 - RNA, 21 nt, Artificial Sequence
  source: /note="Description of Artificial Sequence: Synthetic oligonucleotide"
agacuguucaaguagcauucu

SEQ ID NO: 2586 - RNA, 21 nt, Artificial Sequence
  source: /note="Description of Artificial Sequence: Synthetic oligonucleotide"
gacuguucaaguagcauucca

SEQ ID NO: 2587 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuguucaagtagcauuccaa

SEQ ID NO: 2588 - RNA, 21 nt, Artificial Sequence
  source: /note="Description of Artificial Sequence: Synthetic oligonucleotide"
cuguucaaguagcauuccaau

SEQ ID NO: 2589 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguucaagtagcauuccaauu

SEQ ID NO: 2590 - RNA, 21 nt, Artificial Sequence
  source: /note="Description of Artificial Sequence: Synthetic oligonucleotide"
guucaaguagcauuccaaucu

SEQ ID NO: 2591 - RNA, 21 nt, Artificial Sequence
  source: /note="Description of Artificial Sequence: Synthetic oligonucleotide"
uucaaguagcauuccaaucuu

SEQ ID NO: 2592 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaguagcautccaaucugua

SEQ ID NO: 2593 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguagcatuccaaucuguau

SEQ ID NO: 2594 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcauuccaatcuguagccau

SEQ ID NO: 2595 - RNA, 21 nt, Artificial Sequence
  source: /note="Description of Artificial Sequence: Synthetic oligonucleotide"
gaauaucaacaagaacacaga

SEQ ID NO: 2596 - RNA, 21 nt, Artificial Sequence
  source: /note="Description of Artificial Sequence: Synthetic oligonucleotide"
aagaacacagaaugagugcau

SEQ ID NO: 2597 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacacagaatgagugcacau

SEQ ID NO: 2598 - RNA, 21 nt, Artificial Sequence
  source: /note="Description of Artificial Sequence: Synthetic oligonucleotide"
aacacagaaugagugcacagu

SEQ ID NO: 2599 - RNA, 21 nt, Artificial Sequence
  source: /note="Description of Artificial Sequence: Synthetic oligonucleotide"
cagaaugagugcacagcuaau

SEQ ID NO: 2600 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcagcutuaucucaaccuu

SEQ ID NO: 2601 - RNA, 21 nt, Artificial Sequence
  source: /note="Description of Artificial Sequence: Synthetic oligonucleotide"
gcagcuuuaucucaaccugga

SEQ ID NO: 2602 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagcautugaaagauuucu

SEQ ID NO: 2603 - RNA, 21 nt, Artificial Sequence
  source: /note="Description of Artificial Sequence: Synthetic oligonucleotide"
agcauuugaaagauuucccua

SEQ ID NO: 2604 - RNA, 21 nt, Artificial Sequence
  source: /note="Description of Artificial Sequence: Synthetic oligonucleotide"
cauuugaaagauuucccuagu

SEQ ID NO: 2605 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuugaaagatuucccuagcu

SEQ ID NO: 2606 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaagautucccuagccucu

SEQ ID NO: 2607 - skipped

SEQ ID NO: 2608 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccuagcctcuuccuuuuu

SEQ ID NO: 2609 - RNA, 21 nt, Artificial Sequence
  source: /note="Description of Artificial Sequence: Synthetic oligonucleotide"
aaaacggugcaacucuauucu

SEQ ID NO: 2610 - RNA, 21 nt, Artificial Sequence
  source: /note="Description of Artificial Sequence: Synthetic oligonucleotide"
aaacggugcaacucuauucuu

SEQ ID NO: 2611 - RNA, 21 nt, Artificial Sequence
  source: /note="Description of Artificial Sequence: Synthetic oligonucleotide"
aacggugcaacucuauucugu

SEQ ID NO: 2612 - skipped

SEQ ID NO: 2613 - RNA, 21 nt, Artificial Sequence
  source: /note="Description of Artificial Sequence: Synthetic oligonucleotide"
gugcaacucuauucuggacuu

SEQ ID NO: 2614 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaacuctatucuggacuuu

SEQ ID NO: 2615 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaacucuautcuggacuuua

SEQ ID NO: 2616 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacucuatucuggacuuuau

SEQ ID NO: 2617 - skipped

SEQ ID NO: 2618 - RNA, 21 nt, Artificial Sequence
  source: /note="Description of Artificial Sequence: Synthetic oligonucleotide"
acucuauucuggacuuuauua

SEQ ID NO: 2619 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuauuctggacuuuauuau

SEQ ID NO: 2620 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauucuggactuuauuacuuu

SEQ ID NO: 2621 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucuggacutuauuacuuga

SEQ ID NO: 2622 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuggactutauuacuugau

SEQ ID NO: 2623 - RNA, 21 nt, Artificial Sequence
  source: /note="Description of Artificial Sequence: Synthetic oligonucleotide"
ugaaguccaccaaaaguggau

SEQ ID NO: 2624 - RNA, 21 nt, Artificial Sequence
  source: /note="Description of Artificial Sequence: Synthetic oligonucleotide"
ccaaaaguggacccucuauau

SEQ ID NO: 2625 - RNA, 21 nt, Artificial Sequence
  source: /note="Description of Artificial Sequence: Synthetic oligonucleotide"
caaaaguggacccucuauauu

SEQ ID NO: 2626 - RNA, 21 nt, Artificial Sequence
  source: /note="Description of Artificial Sequence: Synthetic oligonucleotide"
aaaguggacccucuauauuuc

SEQ ID NO: 2627 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguggaccctcuauauuucu

SEQ ID NO: 2628 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucauatatccuugguccu

SEQ ID NO: 2629 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucauauatccuuggucccau

SEQ ID NO: 2630 - RNA, 21 nt, Artificial Sequence
  source: /note="Description of Artificial Sequence: Synthetic oligonucleotide"
gauguuuagacaauuuuaggu

SEQ ID NO: 2631 - RNA, 21 nt, Artificial Sequence
  source: /note="Description of Artificial Sequence: Synthetic oligonucleotide"
auguuuagacaauuuuaggcu

SEQ ID NO: 2632 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuagacaatuuuaggcuca

SEQ ID NO: 2633 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuagacaautuuaggcucaa

SEQ ID NO: 2634 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagacaatutuaggcucaaa

SEQ ID NO: 2635 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagacaaututaggcucaaaa

SEQ ID NO: 2636 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaauuutaggcucaaaaau

SEQ ID NO: 2637 - RNA, 21 nt, Artificial Sequence
  source: /note="Description of Artificial Sequence: Synthetic oligonucleotide"
uuaggcucaaaaauuaaagcu

SEQ ID NO: 2638 - RNA, 21 nt, Artificial Sequence
  source: /note="Description of Artificial Sequence: Synthetic oligonucleotide"
uaggcucaaaaauuaaagcua

SEQ ID NO: 2639 - RNA, 21 nt, Artificial Sequence
  source: /note="Description of Artificial Sequence: Synthetic oligonucleotide"
aggcucaaaaauuaaagcuaa

SEQ ID NO: 2640 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcucaaaaatuaaagcuaau

SEQ ID NO: 2641 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucaaaaautaaagcuaaca

SEQ ID NO: 2642 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucaaaaatuaaagcuaacau

SEQ ID NO: 2643 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaaaautaaagcuaacaca

SEQ ID NO: 2644 - RNA, 21 nt, Artificial Sequence
  source: /note="Description of Artificial Sequence: Synthetic oligonucleotide"
caaaaauuaaagcuaacacau

SEQ ID NO: 2645 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauuaaagctaacacaggaa

SEQ ID NO: 2646 - RNA, 21 nt, Artificial Sequence
  source: /note="Description of Artificial Sequence: Synthetic oligonucleotide"
agcuaacacaggaaaaggaau

SEQ ID NO: 2647 - RNA, 21 nt, Artificial Sequence
  source: /note="Description of Artificial Sequence: Synthetic oligonucleotide"
uaacacaggaaaaggaacugu

SEQ ID NO: 2648 - RNA, 21 nt, Artificial Sequence
  source: /note="Description of Artificial Sequence: Synthetic oligonucleotide"
cacaggaaaaggaacuguacu

SEQ ID NO: 2649 - RNA, 21 nt, Artificial Sequence
  source: /note="Description of Artificial Sequence: Synthetic oligonucleotide"
caggaaaaggaacuguacugu

SEQ ID NO: 2650 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaacugtacuggcuauuau

SEQ ID NO: 2651 - skipped

SEQ ID NO: 2652 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgacucccactacaucaagau

SEQ ID NO: 2653 - RNA, 21 nt, Artificial Sequence
  source: /note="Description of Artificial Sequence: Synthetic oligonucleotide"
cucccacuacaucaagacuaa

SEQ ID NO: 2654 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccacuacatcaagacuaau

SEQ ID NO: 2655 - RNA, 21 nt, Artificial Sequence
  source: /note="Description of Artificial Sequence: Synthetic oligonucleotide"
cccacuacaucaagacuaauu

SEQ ID NO: 2656 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacuacatcaagacuaaucu

SEQ ID NO: 2657 - RNA, 21 nt, Artificial Sequence
  source: /note="Description of Artificial Sequence: Synthetic oligonucleotide"
cacuacaucaagacuaaucuu

SEQ ID NO: 2658 - RNA, 21 nt, Artificial Sequence
  source: /note="Description of Artificial Sequence: Synthetic oligonucleotide"
acuacaucaagacuaaucuuu

SEQ ID NO: 2659 - RNA, 21 nt, Artificial Sequence
  source: /note="Description of Artificial Sequence: Synthetic oligonucleotide"
cuacaucaagacuaaucuugu

SEQ ID NO: 2660 - RNA, 21 nt, Artificial Sequence
  source: /note="Description of Artificial Sequence: Synthetic oligonucleotide"
uacaucaagacuaaucuuguu

SEQ ID NO: 2661 - skipped

SEQ ID NO: 2662 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugugututucacauguau

SEQ ID NO: 2663 - RNA, 21 nt, Artificial Sequence
  source: /note="Description of Artificial Sequence: Synthetic oligonucleotide"
guguuuuucacauguauuaua

SEQ ID NO: 2664 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacauguautauagaaugcu

SEQ ID NO: 2665 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacauguatuauagaaugcuu

SEQ ID NO: 2666 - RNA, 21 nt, Artificial Sequence
  source: /note="Description of Artificial Sequence: Synthetic oligonucleotide"
uguauuauagaaugcuuuugu

SEQ ID NO: 2667 - RNA, 21 nt, Artificial Sequence
  source: /note="Description of Artificial Sequence: Synthetic oligonucleotide"
guauuauagaaugcuuuugca

SEQ ID NO: 2668 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauagaaugctuuugcaugga

SEQ ID NO: 2669 - skipped

SEQ ID NO: 2670 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaugcuutugcauggacuau

SEQ ID NO: 2671 - RNA, 21 nt, Artificial Sequence
  source: /note="Description of Artificial Sequence: Synthetic oligonucleotide"
augcuuuugcauggacuaucu

SEQ ID NO: 2672 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuugcatggacuauccucu

SEQ ID NO: 2673 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcauggactauccucuugu

SEQ ID NO: 2674 - RNA, 21 nt, Artificial Sequence
  source: /note="Description of Artificial Sequence: Synthetic oligonucleotide"
ugcauggacuauccucuuguu

SEQ ID NO: 2675 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcauggactatccucuuguuu

SEQ ID NO: 2676 - RNA, 21 nt, Artificial Sequence
  source: /note="Description of Artificial Sequence: Synthetic oligonucleotide"
cauggacuauccucuuguuuu

SEQ ID NO: 2677 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggacuatccucuuguuuuu

SEQ ID NO: 2678 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacuaucctcuuguuuuua

SEQ ID NO: 2679 - RNA, 21 nt, Artificial Sequence
  source: /note="Description of Artificial Sequence: Synthetic oligonucleotide"
ggacuauccucuuguuuuuau

SEQ ID NO: 2680 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuaucctctuguuuuuauu

SEQ ID NO: 2681 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuauccuctuguuuuuauuaa

SEQ ID NO: 2682 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuctgguucaguccuuguguag

SEQ ID NO: 2683 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccutctgguucaguccuugugu

SEQ ID NO: 2684 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggugatcagaagcagaaggauu

SEQ ID NO: 2685 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugauggugatcagaagcagaa

SEQ ID NO: 2686 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaguagaugauggtgaucagaag

SEQ ID NO: 2687 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagtaggaguagaugaugguga

SEQ ID NO: 2688 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaaguaggagtagaugauggug

SEQ ID NO: 2689 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaagtaggaguagaugauggu

SEQ ID NO: 2690 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atccaaguaggagtagaugaugg

SEQ ID NO: 2691 - RNA, 23 nt, Artificial Sequence
  source: /note="Description of Artificial Sequence: Synthetic oligonucleotide"
aacuccaaguaggaguagaugau

SEQ ID NO: 2692 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgacuccaagtaggaguagaug

SEQ ID NO: 2693 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgactccaaguaggaguagau

SEQ ID NO: 2694 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacgacuccaagtaggaguaga

SEQ ID NO: 2695 - RNA, 23 nt, Artificial Sequence
  source: /note="Description of Artificial Sequence: Synthetic oligonucleotide"
acaacgacuccaaguaggaguag

SEQ ID NO: 2696 - skipped

SEQ ID NO: 2697 - RNA, 23 nt, Artificial Sequence
  source: /note="Description of Artificial Sequence: Synthetic oligonucleotide"
aaccaacgacuccaaguaggagu

SEQ ID NO: 2698 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgaaaaacuucaccaacgacuc

SEQ ID NO: 2699 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuaauaucccacagaaccaaua

SEQ ID NO: 2700 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuatuaauaucccacagaacca

SEQ ID NO: 2701 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgctuauuaatatcccacagaa

SEQ ID NO: 2702 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accuagtuuucggcacucagcug

SEQ ID NO: 2703 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctaguuuucggcacucagcu

SEQ ID NO: 2704 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgcctaguutucggcacucag

SEQ ID NO: 2705 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacgccuagututcggcacuca

SEQ ID NO: 2706 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgacgccuagtutucggcacuc

SEQ ID NO: 2707 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugacgccuagutuucggcacu

SEQ ID NO: 2708 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagugacgccuagtuuucggcac

SEQ ID NO: 2709 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtgacgcctaguuuucggca

SEQ ID NO: 2710 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcgatagaucucuucucuguu

SEQ ID NO: 2711 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuagagagcgauagaucucuuc

SEQ ID NO: 2712 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuuagagagcgatagaucucuu

SEQ ID NO: 2713 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugautuagagagcgauagaucuc

SEQ ID NO: 2714 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgatutagagagcgauagaucu

SEQ ID NO: 2715 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accugatuuagagagcgauagau

SEQ ID NO: 2716 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacctgauuuagagagcgauaga

SEQ ID NO: 2717 - skipped

SEQ ID NO: 2718 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacctgauutagagagcgaua

SEQ ID NO: 2719 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atucaccugautuagagagcgau

SEQ ID NO: 2720 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuctucaccugatuuagagagc

SEQ ID NO: 2721 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atggauauacugucccagcauua

SEQ ID NO: 2722 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuggatauactgtcccagcauu

SEQ ID NO: 2723 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucggcuggatatacuguccca

SEQ ID NO: 2724 - RNA, 23 nt, Artificial Sequence
  source: /note="Description of Artificial Sequence: Synthetic oligonucleotide"
aaagaucggcuggauauacuguc

SEQ ID NO: 2725 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguaaucucuucatccuuggugc

SEQ ID NO: 2726 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguaatcucutcauccuuggug

SEQ ID NO: 2727 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtaaucuctucauccuuggu

SEQ ID NO: 2728 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguugaccucaaatgucuuggua

SEQ ID NO: 2729 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaugutgacctcaaaugucuug

SEQ ID NO: 2730 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggatgtugaccucaaaugucuu

SEQ ID NO: 2731 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataggatguugaccucaaauguc

SEQ ID NO: 2732 - RNA, 23 nt, Artificial Sequence
  source: /note="Description of Artificial Sequence: Synthetic oligonucleotide"
acuaggauguugaccucaaaugu

SEQ ID NO: 2733 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuaggaugutgaccucaaaug

SEQ ID NO: 2734 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguccuaggaugutgaccucaaa

SEQ ID NO: 2735 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgucctaggatgtugaccucaa

SEQ ID NO: 2736 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauguccuaggatguugaccuc

SEQ ID NO: 2737 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaatgtccuaggauguugaccu

SEQ ID NO: 2738 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaaaatgucctaggauguugac

SEQ ID NO: 2739 - RNA, 23 nt, Artificial Sequence
  source: /note="Description of Artificial Sequence: Synthetic oligonucleotide"
acaaaaauguccuaggauguuga

SEQ ID NO: 2740 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaaaaaugucctaggauguug

SEQ ID NO: 2741 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atccaaaaaugtccuaggauguu

SEQ ID NO: 2742 - RNA, 23 nt, Artificial Sequence
  source: /note="Description of Artificial Sequence: Synthetic oligonucleotide"
aauccaaaaauguccuaggaugu

SEQ ID NO: 2743 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugauccaaaaatgtccuaggaug

SEQ ID NO: 2744 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgatccaaaaauguccuaggau

SEQ ID NO: 2745 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugtgauccaaaaauguccuag

SEQ ID NO: 2746 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuugugauccaaaaauguccua

SEQ ID NO: 2747 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuutgtgauccaaaaauguccu

SEQ ID NO: 2748 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugcutuugugatccaaaaaug

SEQ ID NO: 2749 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaagugcuuutgtgauccaaaa

SEQ ID NO: 2750 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaagtgcuutugugauccaaa

SEQ ID NO: 2751 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagaagugcututgugauccaa

SEQ ID NO: 2752 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauggaagaagtgcuuuugugau

SEQ ID NO: 2753 - RNA, 23 nt, Artificial Sequence
  source: /note="Description of Artificial Sequence: Synthetic oligonucleotide"
agauggaagaagugcuuuuguga

SEQ ID NO: 2754 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgatggaagaagtgcuuuugug

SEQ ID NO: 2755 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcgauggaagaagugcuuuugu

SEQ ID NO: 2756 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucgatggaagaagugcuuuug

SEQ ID NO: 2757 - skipped

SEQ ID NO: 2758 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcatcgauggaagaagugcuuu

SEQ ID NO: 2759 - RNA, 23 nt, Artificial Sequence
  source: /note="Description of Artificial Sequence: Synthetic oligonucleotide"
aaucaucgauggaagaagugcuu

SEQ ID NO: 2760 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgauguggccatgauuucucu

SEQ ID NO: 2761 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatgggaugagguaaggaauc

SEQ ID NO: 2762 - RNA, 23 nt, Artificial Sequence
  source: /note="Description of Artificial Sequence: Synthetic oligonucleotide"
aaauaugggaugagguaaggaau

SEQ ID NO: 2763 - RNA, 23 nt, Artificial Sequence
  source: /note="Description of Artificial Sequence: Synthetic oligonucleotide"
uggaacaauaugggaugagguaa

SEQ ID NO: 2764 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuggaacaatatgggaugagg

SEQ ID NO: 2765 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuugctggaacaauaugggaug

SEQ ID NO: 2766 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauutgcuggaacaauaugggau

SEQ ID NO: 2767 - RNA, 23 nt, Artificial Sequence
  source: /note="Description of Artificial Sequence: Synthetic oligonucleotide"
agaccucugugaaagccaacagc

SEQ ID NO: 2768 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgucagaccucugugaaagcca

SEQ ID NO: 2769 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgatgtcagacctcugugaaag

SEQ ID NO: 2770 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcugatgucagaccucugugaa

SEQ ID NO: 2771 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaagutcugatgtcagaccucu

SEQ ID NO: 2772 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugauaccagtutuucccaagg

SEQ ID NO: 2773 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugagguuuugataccaguuuu

SEQ ID NO: 2774 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaugagguuutgauaccaguuu

SEQ ID NO: 2775 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacatgagguutugauaccaguu

SEQ ID NO: 2776 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacaugaggututgauaccagu

SEQ ID NO: 2777 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacatgaggtutugauaccag

SEQ ID NO: 2778 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagacaugaggutuugauacca

SEQ ID NO: 2779 - RNA, 23 nt, Artificial Sequence
  source: /note="Description of Artificial Sequence: Synthetic oligonucleotide"
agcagagacaugagguuuugaua

SEQ ID NO: 2780 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atucacaaaaacugggcagagac

SEQ ID NO: 2781 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtatucacaaaaacugggca

SEQ ID NO: 2782 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacccaguatucacaaaaacu

SEQ ID NO: 2783 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgaacccaguautcacaaaaac

SEQ ID NO: 2784 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtgaacccagtauucacaaa

SEQ ID NO: 2785 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuuggtgaacccaguauucaca

SEQ ID NO: 2786 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuutggugaacccaguauucac

SEQ ID NO: 2787 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuutuggugaacccaguauuca

SEQ ID NO: 2788 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauututggugaacccaguauuc

SEQ ID NO: 2789 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaututuggugaacccaguauu

SEQ ID NO: 2790 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgugctuggatutuuggugaac

SEQ ID NO: 2791 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugtgcuuggautuuuggugaa

SEQ ID NO: 2792 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucutgugctuggauuuuugg

SEQ ID NO: 2793 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataatctugugcutggauuuuug

SEQ ID NO: 2794 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaaucuugugctuggauuuuu

SEQ ID NO: 2795 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agccauaaucutgtgcuuggauu

SEQ ID NO: 2796 - skipped

SEQ ID NO: 2797 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atacaggccauaatcuugugcuu

SEQ ID NO: 2798 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauacaggccataaucuugugcu

SEQ ID NO: 2799 - RNA, 23 nt, Artificial Sequence
  source: /note="Description of Artificial Sequence: Synthetic oligonucleotide"
aaauacaggccauaaucuugugc

SEQ ID NO: 2800 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaatacaggccataaucuugug

SEQ ID NO: 2801 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcuccaauacaggccauaaucu

SEQ ID NO: 2802 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcugucuccaauacaggccaua

SEQ ID NO: 2803 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauctgtcuccaatacaggccau

SEQ ID NO: 2804 - RNA, 23 nt, Artificial Sequence
  source: /note="Description of Artificial Sequence: Synthetic oligonucleotide"
ucaucugucuccaauacaggcca

SEQ ID NO: 2805 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agactucuuacgacuucaucugu

SEQ ID NO: 2806 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacutcuuacgacuucaucug

SEQ ID NO: 2807 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucagacuuctuacgacuucau

SEQ ID NO: 2808 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuatcagacutctuacgacuuc

SEQ ID NO: 2809 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccatctaucagacuucuuacga

SEQ ID NO: 2810 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccaucuaucagacuucuuacg

SEQ ID NO: 2811 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuccatcuaucagacuucuuac

SEQ ID NO: 2812 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauuccaucuatcagacuucuua

SEQ ID NO: 2813 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atautccaucuaucagacuucuu

SEQ ID NO: 2814 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguatuccauctatcagacuucu

SEQ ID NO: 2815 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtatuccatctaucagacuu

SEQ ID NO: 2816 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaguauuccaucuaucagacu

SEQ ID NO: 2817 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utautgguaagtatuccaucuau

SEQ ID NO: 2818 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuatugguaaguauuccaucua

SEQ ID NO: 2819 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuuautgguaagtauuccaucu

SEQ ID NO: 2820 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcutatugguaaguauuccauc

SEQ ID NO: 2821 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuctuauuggtaaguauuccau

SEQ ID NO: 2822 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuucutauugguaaguauucca

SEQ ID NO: 2823 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuutctuauuggtaaguauucc

SEQ ID NO: 2824 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatugauauacgauggaacaa

SEQ ID NO: 2825 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauautgauatacgauggaaca

SEQ ID NO: 2826 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatatugauauacgauggaac

SEQ ID NO: 2827 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagauauugatatacgauggaa

SEQ ID NO: 2828 - RNA, 23 nt, Artificial Sequence
  source: /note="Description of Artificial Sequence: Synthetic oligonucleotide"
aguucaggaagaaacuucuguag

SEQ ID NO: 2829 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcgtucaggaagaaacuucugu

SEQ ID NO: 2830 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcgcgtucaggaagaaacuucu

SEQ ID NO: 2831 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugaggcgcgtucaggaagaaa

SEQ ID NO: 2832 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcugcauacgautuaaaaucgc

SEQ ID NO: 2833 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuctgcauacgatuuaaaaucg

SEQ ID NO: 2834 - skipped

SEQ ID NO: 2835 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaatatucugcatacgauuuaa

SEQ ID NO: 2836 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugaatauuctgcauacgauuu

SEQ ID NO: 2837 - RNA, 23 nt, Artificial Sequence
  source: /note="Description of Artificial Sequence: Synthetic oligonucleotide"
aauugaauauucugcauacgauu

SEQ ID NO: 2838 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaautgaauautctgcauacgau

SEQ ID NO: 2839 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcaaatugaatatucugcauac

SEQ ID NO: 2840 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucaaauugaatauucugcau

SEQ ID NO: 2841 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacugctucaaautgaauauucu

SEQ ID NO: 2842 - skipped

SEQ ID NO: 2843 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautaucatgcauacaucuc

SEQ ID NO: 2844 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcautgauucgaaacuauuca

SEQ ID NO: 2845 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauaaagcuutgcagcauugau

SEQ ID NO: 2846 - RNA, 23 nt, Artificial Sequence
  source: /note="Description of Artificial Sequence: Synthetic oligonucleotide"
aaaaaugugaaauaaagcuuugc

SEQ ID NO: 2847 - skipped

SEQ ID NO: 2848 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atagtgccaaaccaauguuuuua

SEQ ID NO: 2849 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggtaauuaatctuguucguuu

SEQ ID NO: 2850 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacagguaautaaucuuguucg

SEQ ID NO: 2851 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggaagacaggtaauuaaucuug

SEQ ID NO: 2852 - RNA, 23 nt, Artificial Sequence
  source: /note="Description of Artificial Sequence: Synthetic oligonucleotide"
aaggaagacagguaauuaaucuu

SEQ ID NO: 2853 - RNA, 23 nt, Artificial Sequence
  source: /note="Description of Artificial Sequence: Synthetic oligonucleotide"
aaacaggaagacagguaauuaau

SEQ ID NO: 2854 - RNA, 23 nt, Artificial Sequence
  source: /note="Description of Artificial Sequence: Synthetic oligonucleotide"
gaaacaggaagacagguaauuaa

SEQ ID NO: 2855 - RNA, 23 nt, Artificial Sequence
  source: /note="Description of Artificial Sequence: Synthetic oligonucleotide"
agaaacaggaagacagguaauua

SEQ ID NO: 2856 - RNA, 23 nt, Artificial Sequence
  source: /note="Description of Artificial Sequence: Synthetic oligonucleotide"
aagaaacaggaagacagguaauu

SEQ ID NO: 2857 - RNA, 23 nt, Artificial Sequence
  source: /note="Description of Artificial Sequence: Synthetic oligonucleotide"
ugagaaacaggaagacagguaau

SEQ ID NO: 2858 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgagaaacaggaagacagguaa

SEQ ID NO: 2859 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugagaaacaggaagacaggua

SEQ ID NO: 2860 - RNA, 23 nt, Artificial Sequence
  source: /note="Description of Artificial Sequence: Synthetic oligonucleotide"
acaugaaaggaaaaacagaccua

SEQ ID NO: 2861 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcatgaaaggaaaaacagaccu

SEQ ID NO: 2862 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaagaggcaugaaaggaaaaac

SEQ ID NO: 2863 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuutaagaggcatgaaaggaaa

SEQ ID NO: 2864 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguututaagaggcaugaaagga

SEQ ID NO: 2865 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atccaccuuuaaatggaaaaaua

SEQ ID NO: 2866 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucccugugtaaauaaguucu

SEQ ID NO: 2867 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaccutcccuguguaaauaagu

SEQ ID NO: 2868 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguctuaaacctucccuguguaa

SEQ ID NO: 2869 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagucutaaaccutcccugugua

SEQ ID NO: 2870 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacagtcuuaaaccuucccugu

SEQ ID NO: 2871 - RNA, 23 nt, Artificial Sequence
  source: /note="Description of Artificial Sequence: Synthetic oligonucleotide"
ugaacagucuuaaaccuucccug

SEQ ID NO: 2872 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgaacagucutaaaccuucccu

SEQ ID NO: 2873 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugaacaguctuaaaccuuccc

SEQ ID NO: 2874 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuugaacagucutaaaccuucc

SEQ ID NO: 2875 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacutgaacagtctuaaaccuuc

SEQ ID NO: 2876 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atactugaacagucuuaaaccuu

SEQ ID NO: 2877 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuactugaacagucuuaaacc

SEQ ID NO: 2878 - skipped

SEQ ID NO: 2879 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaugctacuugaacagucuuaa

SEQ ID NO: 2880 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaatgcuacutgaacagucuua

SEQ ID NO: 2881 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggaaugcuactugaacagucuu

SEQ ID NO: 2882 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggaatgcuacutgaacagucu

SEQ ID NO: 2883 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuggaaugcuactugaacaguc

SEQ ID NO: 2884 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuggaaugctacuugaacagu

SEQ ID NO: 2885 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautggaaugcuacuugaacag

SEQ ID NO: 2886 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatuggaaugctacuugaaca

SEQ ID NO: 2887 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacagatuggaaugcuacuugaa

SEQ ID NO: 2888 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atacagauuggaatgcuacuuga

SEQ ID NO: 2889 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atggcuacagatuggaaugcuac

SEQ ID NO: 2890 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtgtucuugutgauauucug

SEQ ID NO: 2891 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgcactcauucuguguucuugu

SEQ ID NO: 2892 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgugcacucatucuguguucuu

SEQ ID NO: 2893 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugtgcacucautcuguguucu

SEQ ID NO: 2894 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuagctgugcactcauucugug

SEQ ID NO: 2895 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggtugagauaaagcugccugc

SEQ ID NO: 2896 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaggtugagauaaagcugccu

SEQ ID NO: 2897 - RNA, 23 nt, Artificial Sequence
  source: /note="Description of Artificial Sequence: Synthetic oligonucleotide"
agaaaucuuucaaaugcugaauc

SEQ ID NO: 2898 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagggaaaucutucaaaugcuga

SEQ ID NO: 2899 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuagggaaaucutucaaaugcu

SEQ ID NO: 2900 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcuagggaaatctuucaaaugc

SEQ ID NO: 2901 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggctagggaaaucuuucaaa

SEQ ID NO: 2902 - skipped

SEQ ID NO: 2903 - RNA, 23 nt, Artificial Sequence
  source: /note="Description of Artificial Sequence: Synthetic oligonucleotide"
aaaaaggaagaggcuagggaaau

SEQ ID NO: 2904 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaatagaguugcaccguuuugg

SEQ ID NO: 2905 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaauagagutgcaccguuuug

SEQ ID NO: 2906 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagaatagagtugcaccguuuu

SEQ ID NO: 2907 - skipped

SEQ ID NO: 2908 - RNA, 23 nt, Artificial Sequence
  source: /note="Description of Artificial Sequence: Synthetic oligonucleotide"
aaguccagaauagaguugcaccg

SEQ ID NO: 2909 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagtccagaatagaguugcacc

SEQ ID NO: 2910 - RNA, 23 nt, Artificial Sequence
  source: /note="Description of Artificial Sequence: Synthetic oligonucleotide"
uaaaguccagaauagaguugcac

SEQ ID NO: 2911 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaagtccagaatagaguugca

SEQ ID NO: 2912 - skipped

SEQ ID NO: 2913 - RNA, 23 nt, Artificial Sequence
  source: /note="Description of Artificial Sequence: Synthetic oligonucleotide"
uaauaaaguccagaauagaguug

SEQ ID NO: 2914 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataataaaguccagaauagaguu

SEQ ID NO: 2915 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagtaauaaaguccagaauaga

SEQ ID NO: 2916 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaguaauaaagtccagaauag

SEQ ID NO: 2917 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcaagtaauaaaguccagaaua

SEQ ID NO: 2918 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atccactuuugguggacuucaga

SEQ ID NO: 2919 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atauagaggguccacuuuuggug

SEQ ID NO: 2920 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatagagggtccacuuuuggu

SEQ ID NO: 2921 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
gaaatatagagggtccacuuuug

SEQ ID NO: 2922 - RNA, 23 nt, Artificial Sequence
  source: /note="Description of Artificial Sequence: Synthetic oligonucleotide"
agaaauauagaggguccacuuuu

SEQ ID NO: 2923 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggaccaaggatataugaaagca

SEQ ID NO: 2924 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgggaccaaggatauaugaaag

SEQ ID NO: 2925 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accuaaaauugtctaaacaucuc

SEQ ID NO: 2926 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctaaaauugucuaaacaucu

SEQ ID NO: 2927 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagcctaaaatugucuaaacau

SEQ ID NO: 2928 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgagccuaaaautgucuaaaca

SEQ ID NO: 2929 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugagccuaaaatugucuaaac

SEQ ID NO: 2930 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuugagccuaaaauugucuaaa

SEQ ID NO: 2931 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuutugagcctaaaauugucua

SEQ ID NO: 2932 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutuaauuutugagccuaaaa

SEQ ID NO: 2933 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagctutaauututgagccuaaa

SEQ ID NO: 2934 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utagcutuaaututugagccuaa

SEQ ID NO: 2935 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuagctuuaatutuugagccua

SEQ ID NO: 2936 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguuagcuuuaautuuugagccu

SEQ ID NO: 2937 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgutagcuuuaatuuuugagcc

SEQ ID NO: 2938 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugtuagcuutaauuuuugagc

SEQ ID NO: 2939 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgugutagcutuaauuuuugag

SEQ ID NO: 2940 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcctgtguuagctuuaauuuuu

SEQ ID NO: 2941 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuccutuucctgtguuagcuuu

SEQ ID NO: 2942 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtuccuuutccuguguuagc

SEQ ID NO: 2943 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguacaguucctutuccuguguu

SEQ ID NO: 2944 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtacaguucctuuuccugug

SEQ ID NO: 2945 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataatagccagtacaguuccuuu

SEQ ID NO: 2946 - skipped

SEQ ID NO: 2947 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcutgauguagugggagucgga

SEQ ID NO: 2948 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utagtctugauguagugggaguc

SEQ ID NO: 2949 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atuagucuugatgtagugggagu

SEQ ID NO: 2950 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuagtcuugauguagugggag

SEQ ID NO: 2951 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautagucuugatguaguggga

SEQ ID NO: 2952 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatuagucutgauguaguggg

SEQ ID NO: 2953 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagautaguctugauguagugg

SEQ ID NO: 2954 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaagatuagucutgauguagug

SEQ ID NO: 2955 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaagauuagtctugauguagu

SEQ ID NO: 2956 - skipped

SEQ ID NO: 2957 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atacaugugaaaaacacacaaaa

SEQ ID NO: 2958 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaauacaugtgaaaaacacac

SEQ ID NO: 2959 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcatucuauaauacaugugaaa

SEQ ID NO: 2960 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcautcuauaatacaugugaa

SEQ ID NO: 2961 - RNA, 23 nt, Artificial Sequence
  source: /note="Description of Artificial Sequence: Synthetic oligonucleotide"
acaaaagcauucuauaauacaug

SEQ ID NO: 2962 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaaagcautctauaauacau

SEQ ID NO: 2963 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccatgcaaaagcauucuauaau

SEQ ID NO: 2964 - skipped

SEQ ID NO: 2965 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atagtccaugcaaaagcauucua

SEQ ID NO: 2966 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauagtccaugcaaaagcauuc

SEQ ID NO: 2967 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggataguccatgcaaaagca

SEQ ID NO: 2968 - RNA, 23 nt, Artificial Sequence
  source: /note="Description of Artificial Sequence: Synthetic oligonucleotide"
acaagaggauaguccaugcaaaa

SEQ ID NO: 2969 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaagaggauagtccaugcaaa

SEQ ID NO: 2970 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacaagaggataguccaugcaa

SEQ ID NO: 2971 - RNA, 23 nt, Artificial Sequence
  source: /note="Description of Artificial Sequence: Synthetic oligonucleotide"
aaaacaagaggauaguccaugca

SEQ ID NO: 2972 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaacaagaggataguccaugc

SEQ ID NO: 2973 - RNA, 23 nt, Artificial Sequence
  source: /note="Description of Artificial Sequence: Synthetic oligonucleotide"
uaaaaacaagaggauaguccaug

SEQ ID NO: 2974 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaacaagaggauaguccau

SEQ ID NO: 2975 - RNA, 23 nt, Artificial Sequence
  source: /note="Description of Artificial Sequence: Synthetic oligonucleotide"
aauaaaaacaagaggauagucca

SEQ ID NO: 2976 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaataaaaacaagaggauaguc

SEQ ID NO: 2977 - protein, 16 aa, Unknown
  source: /note="Description of Unknown: RFGF peptide"
AAVALLPAVLLALLAP

SEQ ID NO: 2978 - protein, 11 aa, Unknown
  source: /note="Description of Unknown: RFGF analogue peptide"
AALLPVLLAAP

SEQ ID NO: 2979 - protein, 13 aa, Human immunodeficiency virus
GRKKRRQRRRPPQ

SEQ ID NO: 2980 - protein, 16 aa, Drosophila sp.
RQIKIWFQNRRMKWKK

SEQ ID NO: 2981 - RNA, 21 nt, Artificial Sequence
  source: /note="Description of Artificial Sequence: Synthetic oligonucleotide"
aguaccuccucccuaggacua

SEQ ID NO: 2982 - RNA, 21 nt, Artificial Sequence
  source: /note="Description of Artificial Sequence: Synthetic oligonucleotide"
uccuucugcuucugaucacca

SEQ ID NO: 2983 - RNA, 21 nt, Artificial Sequence
  source: /note="Description of Artificial Sequence: Synthetic oligonucleotide"
caucaucuacuccuacuugga

SEQ ID NO: 2984 - RNA, 21 nt, Artificial Sequence
  source: /note="Description of Artificial Sequence: Synthetic oligonucleotide"
ucuacuccuacuuggagucgu

SEQ ID NO: 2985 - RNA, 21 nt, Artificial Sequence
  source: /note="Description of Artificial Sequence: Synthetic oligonucleotide"
cuacuccuacuuggagucguu

SEQ ID NO: 2986 - RNA, 21 nt, Artificial Sequence
  source: /note="Description of Artificial Sequence: Synthetic oligonucleotide"
guaccuccucccuaggacuau

SEQ ID NO: 2987 - RNA, 21 nt, Artificial Sequence
  source: /note="Description of Artificial Sequence: Synthetic oligonucleotide"
acacaaggacugaaccagaau

SEQ ID NO: 2988 - RNA, 21 nt, Artificial Sequence
  source: /note="Description of Artificial Sequence: Synthetic oligonucleotide"
accaucaucuacuccuacuuu

SEQ ID NO: 2989 - RNA, 21 nt, Artificial Sequence
  source: /note="Description of Artificial Sequence: Synthetic oligonucleotide"
ccaucaucuacuccuacuugu

SEQ ID NO: 2990 - RNA, 21 nt, Artificial Sequence
  source: /note="Description of Artificial Sequence: Synthetic oligonucleotide"
aucaucuacuccuacuuggau

SEQ ID NO: 2991 - RNA, 21 nt, Artificial Sequence
  source: /note="Description of Artificial Sequence: Synthetic oligonucleotide"
caucuacuccuacuuggaguu

SEQ ID NO: 2992 - RNA, 21 nt, Artificial Sequence
  source: /note="Description of Artificial Sequence: Synthetic oligonucleotide"
uacuccuacuuggagucguuu

SEQ ID NO: 2993 - RNA, 21 nt, Artificial Sequence
  source: /note="Description of Artificial Sequence: Synthetic oligonucleotide"
acuccuacuuggagucguugu

SEQ ID NO: 2994 - RNA, 21 nt, Artificial Sequence
  source: /note="Description of Artificial Sequence: Synthetic oligonucleotide"
cuccuacuuggagucguuggu

SEQ ID NO: 2995 - RNA, 21 nt, Artificial Sequence
  source: /note="Description of Artificial Sequence: Synthetic oligonucleotide"
uccuacuuggagucguugguu

SEQ ID NO: 2996 - RNA, 21 nt, Artificial Sequence
  source: /note="Description of Artificial Sequence: Synthetic oligonucleotide"
aacugcagcugagugccgaaa

SEQ ID NO: 2997 - RNA, 21 nt, Artificial Sequence
  source: /note="Description of Artificial Sequence: Synthetic oligonucleotide"
acugcagcugagugccgaaaa

SEQ ID NO: 2998 - RNA, 21 nt, Artificial Sequence
  source: /note="Description of Artificial Sequence: Synthetic oligonucleotide"
ugcagcugagugccgaaaacu

SEQ ID NO: 2999 - RNA, 21 nt, Artificial Sequence
  source: /note="Description of Artificial Sequence: Synthetic oligonucleotide"
gcagcugagugccgaaaacua

SEQ ID NO: 3000 - RNA, 21 nt, Artificial Sequence
  source: /note="Description of Artificial Sequence: Synthetic oligonucleotide"
agugccgaaaacuaggcguca

SEQ ID NO: 3001 - RNA, 21 nt, Artificial Sequence
  source: /note="Description of Artificial Sequence: Synthetic oligonucleotide"
ugccgaaaacuaggcgucacu

SEQ ID NO: 3002 - RNA, 21 nt, Artificial Sequence
  source: /note="Description of Artificial Sequence: Synthetic oligonucleotide"
cugugggauauuaauaagcgu

SEQ ID NO: 3003 - RNA, 21 nt, Artificial Sequence
  source: /note="Description of Artificial Sequence: Synthetic oligonucleotide"
caguaccuccucccuaggacu

SEQ ID NO: 3004 - RNA, 21 nt, Artificial Sequence
  source: /note="Description of Artificial Sequence: Synthetic oligonucleotide"
aguaccuccucccuaggacua

SEQ ID NO: 3005 - RNA, 21 nt, Artificial Sequence
  source: /note="Description of Artificial Sequence: Synthetic oligonucleotide"
guaccuccucccuaggacuaa

SEQ ID NO: 3006 - RNA, 21 nt, Artificial Sequence
  source: /note="Description of Artificial Sequence: Synthetic oligonucleotide"
acuacacaaggacugaaccaa

SEQ ID NO: 3007 - RNA, 21 nt, Artificial Sequence
  source: /note="Description of Artificial Sequence: Synthetic oligonucleotide"
cuacacaaggacugaaccaga

SEQ ID NO: 3008 - RNA, 21 nt, Artificial Sequence
  source: /note="Description of Artificial Sequence: Synthetic oligonucleotide"
acacaaggacugaaccagaaa

SEQ ID NO: 3009 - RNA, 21 nt, Artificial Sequence
  source: /note="Description of Artificial Sequence: Synthetic oligonucleotide"
cagagcaaagccaugaacaua

SEQ ID NO: 3010 - RNA, 21 nt, Artificial Sequence
  source: /note="Description of Artificial Sequence: Synthetic oligonucleotide"
ucauccuagaaauccuucuga

SEQ ID NO: 3011 - RNA, 21 nt, Artificial Sequence
  source: /note="Description of Artificial Sequence: Synthetic oligonucleotide"
uccuucugcuucugaucacca

SEQ ID NO: 3012 - RNA, 21 nt, Artificial Sequence
  source: /note="Description of Artificial Sequence: Synthetic oligonucleotide"
ccaucaucuacuccuacuuga

SEQ ID NO: 3013 - RNA, 21 nt, Artificial Sequence
  source: /note="Description of Artificial Sequence: Synthetic oligonucleotide"
ucuacuccuacuuggagucgu

SEQ ID NO: 3014 - RNA, 21 nt, Artificial Sequence
  source: /note="Description of Artificial Sequence: Synthetic oligonucleotide"
cuacuccuacuuggagucguu

SEQ ID NO: 3015 - RNA, 21 nt, Artificial Sequence
  source: /note="Description of Artificial Sequence: Synthetic oligonucleotide"
uacuccuacuuggagucguua

SEQ ID NO: 3016 - RNA, 21 nt, Artificial Sequence
  source: /note="Description of Artificial Sequence: Synthetic oligonucleotide"
acuccuacuuggagucguuga

SEQ ID NO: 3017 - RNA, 21 nt, Artificial Sequence
  source: /note="Description of Artificial Sequence: Synthetic oligonucleotide"
cuccuacuuggagucguuggu

SEQ ID NO: 3018 - RNA, 21 nt, Artificial Sequence
  source: /note="Description of Artificial Sequence: Synthetic oligonucleotide"
uccuacuuggagucguuggua

SEQ ID NO: 3019 - RNA, 21 nt, Artificial Sequence
  source: /note="Description of Artificial Sequence: Synthetic oligonucleotide"
gucguuggugaaguuuuucau

SEQ ID NO: 3020 - RNA, 21 nt, Artificial Sequence
  source: /note="Description of Artificial Sequence: Synthetic oligonucleotide"
gagauuguucucauuacugga

SEQ ID NO: 3021 - RNA, 21 nt, Artificial Sequence
  source: /note="Description of Artificial Sequence: Synthetic oligonucleotide"
uuguucucauuacuggagcua

SEQ ID NO: 3022 - RNA, 21 nt, Artificial Sequence
  source: /note="Description of Artificial Sequence: Synthetic oligonucleotide"
gcagacuacuuaugaauuuga

SEQ ID NO: 3023 - RNA, 21 nt, Artificial Sequence
  source: /note="Description of Artificial Sequence: Synthetic oligonucleotide"
acuuaugaauuugcaaaacga

SEQ ID NO: 3024 - RNA, 21 nt, Artificial Sequence
  source: /note="Description of Artificial Sequence: Synthetic oligonucleotide"
auuugcaaaacgacagagcau

SEQ ID NO: 3025 - RNA, 21 nt, Artificial Sequence
  source: /note="Description of Artificial Sequence: Synthetic oligonucleotide"
uuugcaaaacgacagagcaua

SEQ ID NO: 3026 - RNA, 21 nt, Artificial Sequence
  source: /note="Description of Artificial Sequence: Synthetic oligonucleotide"
cagagcauauugguucuguga

SEQ ID NO: 3027 - RNA, 21 nt, Artificial Sequence
  source: /note="Description of Artificial Sequence: Synthetic oligonucleotide"
agagcauauugguucugugga

SEQ ID NO: 3028 - RNA, 21 nt, Artificial Sequence
  source: /note="Description of Artificial Sequence: Synthetic oligonucleotide"
gagcauauugguucuguggga

SEQ ID NO: 3029 - RNA, 21 nt, Artificial Sequence
  source: /note="Description of Artificial Sequence: Synthetic oligonucleotide"
cugugggauauuaauaagcga

SEQ ID NO: 3030 - RNA, 21 nt, Artificial Sequence
  source: /note="Description of Artificial Sequence: Synthetic oligonucleotide"
auuaauaagcgcgguguggaa

SEQ ID NO: 3031 - RNA, 21 nt, Artificial Sequence
  source: /note="Description of Artificial Sequence: Synthetic oligonucleotide"
uuaauaagcgcgguguggaga

SEQ ID NO: 3032 - RNA, 21 nt, Artificial Sequence
  source: /note="Description of Artificial Sequence: Synthetic oligonucleotide"
aaacugcagcugagugccgaa

SEQ ID NO: 3033 - RNA, 21 nt, Artificial Sequence
  source: /note="Description of Artificial Sequence: Synthetic oligonucleotide"
aacugcagcugagugccgaaa

SEQ ID NO: 3034 - RNA, 21 nt, Artificial Sequence
  source: /note="Description of Artificial Sequence: Synthetic oligonucleotide"
acugcagcugagugccgaaaa

SEQ ID NO: 3035 - RNA, 21 nt, Artificial Sequence
  source: /note="Description of Artificial Sequence: Synthetic oligonucleotide"
cugcagcugagugccgaaaac

SEQ ID NO: 3036 - RNA, 21 nt, Artificial Sequence
  source: /note="Description of Artificial Sequence: Synthetic oligonucleotide"
ugcagcugagugccgaaaacu

SEQ ID NO: 3037 - RNA, 21 nt, Artificial Sequence
  source: /note="Description of Artificial Sequence: Synthetic oligonucleotide"
gcagcugagugccgaaaacua

SEQ ID NO: 3038 - RNA, 21 nt, Artificial Sequence
  source: /note="Description of Artificial Sequence: Synthetic oligonucleotide"
cagcugagugccgaaaacuaa

SEQ ID NO: 3039 - RNA, 21 nt, Artificial Sequence
  source: /note="Description of Artificial Sequence: Synthetic oligonucleotide"
gcugagugccgaaaacuagga

SEQ ID NO: 3040 - RNA, 21 nt, Artificial Sequence
  source: /note="Description of Artificial Sequence: Synthetic oligonucleotide"
cugagugccgaaaacuaggca

SEQ ID NO: 3041 - RNA, 21 nt, Artificial Sequence
  source: /note="Description of Artificial Sequence: Synthetic oligonucleotide"
ugagugccgaaaacuaggcgu

SEQ ID NO: 3042 - RNA, 21 nt, Artificial Sequence
  source: /note="Description of Artificial Sequence: Synthetic oligonucleotide"
gagugccgaaaacuaggcgua

SEQ ID NO: 3043 - RNA, 21 nt, Artificial Sequence
  source: /note="Description of Artificial Sequence: Synthetic oligonucleotide"
agugccgaaaacuaggcguca

SEQ ID NO: 3044 - RNA, 21 nt, Artificial Sequence
  source: /note="Description of Artificial Sequence: Synthetic oligonucleotide"
gugccgaaaacuaggcgucaa

SEQ ID NO: 3045 - RNA, 21 nt, Artificial Sequence
  source: /note="Description of Artificial Sequence: Synthetic oligonucleotide"
ugccgaaaacuaggcgucacu

SEQ ID NO: 3046 - RNA, 21 nt, Artificial Sequence
  source: /note="Description of Artificial Sequence: Synthetic oligonucleotide"
gccgaaaacuaggcgucacua

SEQ ID NO: 3047 - RNA, 21 nt, Artificial Sequence
  source: /note="Description of Artificial Sequence: Synthetic oligonucleotide"
ccgaaaacuaggcgucacuga

SEQ ID NO: 3048 - RNA, 21 nt, Artificial Sequence
  source: /note="Description of Artificial Sequence: Synthetic oligonucleotide"
cgaaaacuaggcgucacugca

SEQ ID NO: 3049 - RNA, 21 nt, Artificial Sequence
  source: /note="Description of Artificial Sequence: Synthetic oligonucleotide"
aaaacuaggcgucacugcgca

SEQ ID NO: 3050 - RNA, 21 nt, Artificial Sequence
  source: /note="Description of Artificial Sequence: Synthetic oligonucleotide"
aacuaggcgucacugcgcaua

SEQ ID NO: 3051 - RNA, 21 nt, Artificial Sequence
  source: /note="Description of Artificial Sequence: Synthetic oligonucleotide"
acuaggcgucacugcgcauga

SEQ ID NO: 3052 - RNA, 21 nt, Artificial Sequence
  source: /note="Description of Artificial Sequence: Synthetic oligonucleotide"
ggcgucacugcgcaugcguau

SEQ ID NO: 3053 - RNA, 21 nt, Artificial Sequence
  source: /note="Description of Artificial Sequence: Synthetic oligonucleotide"
gcaugcguaugugguagacua

SEQ ID NO: 3054 - RNA, 21 nt, Artificial Sequence
  source: /note="Description of Artificial Sequence: Synthetic oligonucleotide"
caugcguaugugguagacuga

SEQ ID NO: 3055 - RNA, 21 nt, Artificial Sequence
  source: /note="Description of Artificial Sequence: Synthetic oligonucleotide"
aacagagaagagaucuaucga

SEQ ID NO: 3056 - RNA, 21 nt, Artificial Sequence
  source: /note="Description of Artificial Sequence: Synthetic oligonucleotide"
acagagaagagaucuaucgcu

SEQ ID NO: 3057 - RNA, 21 nt, Artificial Sequence
  source: /note="Description of Artificial Sequence: Synthetic oligonucleotide"
cagagaagagaucuaucgcua

SEQ ID NO: 3058 - RNA, 21 nt, Artificial Sequence
  source: /note="Description of Artificial Sequence: Synthetic oligonucleotide"
agagaagagaucuaucgcucu

SEQ ID NO: 3059 - RNA, 21 nt, Artificial Sequence
  source: /note="Description of Artificial Sequence: Synthetic oligonucleotide"
gagaagagaucuaucgcucua

SEQ ID NO: 3060 - RNA, 21 nt, Artificial Sequence
  source: /note="Description of Artificial Sequence: Synthetic oligonucleotide"
gaagagaucuaucgcucucua

SEQ ID NO: 3061 - RNA, 21 nt, Artificial Sequence
  source: /note="Description of Artificial Sequence: Synthetic oligonucleotide"
aagagaucuaucgcucucuaa

SEQ ID NO: 3062 - RNA, 21 nt, Artificial Sequence
  source: /note="Description of Artificial Sequence: Synthetic oligonucleotide"
agagaucuaucgcucucuaaa

SEQ ID NO: 3063 - RNA, 21 nt, Artificial Sequence
  source: /note="Description of Artificial Sequence: Synthetic oligonucleotide"
gaucuaucgcucucuaaauca

SEQ ID NO: 3064 - RNA, 21 nt, Artificial Sequence
  source: /note="Description of Artificial Sequence: Synthetic oligonucleotide"
aucuaucgcucucuaaaucaa

SEQ ID NO: 3065 - RNA, 21 nt, Artificial Sequence
  source: /note="Description of Artificial Sequence: Synthetic oligonucleotide"
cuaucgcucucuaaaucaggu

SEQ ID NO: 3066 - RNA, 21 nt, Artificial Sequence
  source: /note="Description of Artificial Sequence: Synthetic oligonucleotide"
uaucgcucucuaaaucaggua

SEQ ID NO: 3067 - RNA, 21 nt, Artificial Sequence
  source: /note="Description of Artificial Sequence: Synthetic oligonucleotide"
aucgcucucuaaaucagguga

SEQ ID NO: 3068 - RNA, 21 nt, Artificial Sequence
  source: /note="Description of Artificial Sequence: Synthetic oligonucleotide"
gauguaacaaucguggugaau

SEQ ID NO: 3069 - RNA, 21 nt, Artificial Sequence
  source: /note="Description of Artificial Sequence: Synthetic oligonucleotide"
auguaacaaucguggugaaua

SEQ ID NO: 3070 - RNA, 21 nt, Artificial Sequence
  source: /note="Description of Artificial Sequence: Synthetic oligonucleotide"
uguaacaaucguggugaauaa

SEQ ID NO: 3071 - RNA, 21 nt, Artificial Sequence
  source: /note="Description of Artificial Sequence: Synthetic oligonucleotide"
guaacaaucguggugaauaau

SEQ ID NO: 3072 - RNA, 21 nt, Artificial Sequence
  source: /note="Description of Artificial Sequence: Synthetic oligonucleotide"
ggugaauaaugcugggacagu

SEQ ID NO: 3073 - RNA, 21 nt, Artificial Sequence
  source: /note="Description of Artificial Sequence: Synthetic oligonucleotide"
augcugggacaguauauccaa

SEQ ID NO: 3074 - RNA, 21 nt, Artificial Sequence
  source: /note="Description of Artificial Sequence: Synthetic oligonucleotide"
ugcugggacaguauauccaga

SEQ ID NO: 3075 - RNA, 21 nt, Artificial Sequence
  source: /note="Description of Artificial Sequence: Synthetic oligonucleotide"
gcugggacaguauauccagca

SEQ ID NO: 3076 - RNA, 21 nt, Artificial Sequence
  source: /note="Description of Artificial Sequence: Synthetic oligonucleotide"
ugggacaguauauccagccga

SEQ ID NO: 3077 - RNA, 21 nt, Artificial Sequence
  source: /note="Description of Artificial Sequence: Synthetic oligonucleotide"
gggacaguauauccagccgau

SEQ ID NO: 3078 - RNA, 21 nt, Artificial Sequence
  source: /note="Description of Artificial Sequence: Synthetic oligonucleotide"
ggacaguauauccagccgaua

SEQ ID NO: 3079 - RNA, 21 nt, Artificial Sequence
  source: /note="Description of Artificial Sequence: Synthetic oligonucleotide"
caguauauccagccgaucuua

SEQ ID NO: 3080 - RNA, 21 nt, Artificial Sequence
  source: /note="Description of Artificial Sequence: Synthetic oligonucleotide"
gccgaucuucucagcaccaaa

SEQ ID NO: 3081 - RNA, 21 nt, Artificial Sequence
  source: /note="Description of Artificial Sequence: Synthetic oligonucleotide"
ucuucucagcaccaaggauga

SEQ ID NO: 3082 - RNA, 21 nt, Artificial Sequence
  source: /note="Description of Artificial Sequence: Synthetic oligonucleotide"
ccaaggaugaagagauuacca

SEQ ID NO: 3083 - RNA, 21 nt, Artificial Sequence
  source: /note="Description of Artificial Sequence: Synthetic oligonucleotide"
auuaccaagacauuugaggua

SEQ ID NO: 3084 - RNA, 21 nt, Artificial Sequence
  source: /note="Description of Artificial Sequence: Synthetic oligonucleotide"
ccaagacauuugaggucaaca

SEQ ID NO: 3085 - RNA, 21 nt, Artificial Sequence
  source: /note="Description of Artificial Sequence: Synthetic oligonucleotide"
aagacauuugaggucaacaua

SEQ ID NO: 3086 - RNA, 21 nt, Artificial Sequence
  source: /note="Description of Artificial Sequence: Synthetic oligonucleotide"
cauuugaggucaacauccuaa

SEQ ID NO: 3087 - RNA, 21 nt, Artificial Sequence
  source: /note="Description of Artificial Sequence: Synthetic oligonucleotide"
auuugaggucaacauccuaga

SEQ ID NO: 3088 - RNA, 21 nt, Artificial Sequence
  source: /note="Description of Artificial Sequence: Synthetic oligonucleotide"
ggucaacauccuaggacauuu

SEQ ID NO: 3089 - RNA, 21 nt, Artificial Sequence
  source: /note="Description of Artificial Sequence: Synthetic oligonucleotide"
gucaacauccuaggacauuuu

SEQ ID NO: 3090 - RNA, 21 nt, Artificial Sequence
  source: /note="Description of Artificial Sequence: Synthetic oligonucleotide"
uccuaggacauuuuuggauca

SEQ ID NO: 3091 - RNA, 21 nt, Artificial Sequence
  source: /note="Description of Artificial Sequence: Synthetic oligonucleotide"
uuuuuggaucacaaaagcacu

SEQ ID NO: 3092 - RNA, 21 nt, Artificial Sequence
  source: /note="Description of Artificial Sequence: Synthetic oligonucleotide"
aagcacuucuuccaucgauga

SEQ ID NO: 3093 - RNA, 21 nt, Artificial Sequence
  source: /note="Description of Artificial Sequence: Synthetic oligonucleotide"
agcacuucuuccaucgaugau

SEQ ID NO: 3094 - RNA, 21 nt, Artificial Sequence
  source: /note="Description of Artificial Sequence: Synthetic oligonucleotide"
auggagagaaaucauggccaa

SEQ ID NO: 3095 - RNA, 21 nt, Artificial Sequence
  source: /note="Description of Artificial Sequence: Synthetic oligonucleotide"
ggagagaaaucauggccacau

SEQ ID NO: 3096 - RNA, 21 nt, Artificial Sequence
  source: /note="Description of Artificial Sequence: Synthetic oligonucleotide"
gagaaaucauggccacaucgu

SEQ ID NO: 3097 - RNA, 21 nt, Artificial Sequence
  source: /note="Description of Artificial Sequence: Synthetic oligonucleotide"
agaaaucauggccacaucgua

SEQ ID NO: 3098 - RNA, 21 nt, Artificial Sequence
  source: /note="Description of Artificial Sequence: Synthetic oligonucleotide"
gaaaucauggccacaucguca

SEQ ID NO: 3099 - RNA, 21 nt, Artificial Sequence
  source: /note="Description of Artificial Sequence: Synthetic oligonucleotide"
aaaucauggccacaucgucaa

SEQ ID NO: 3100 - RNA, 21 nt, Artificial Sequence
  source: /note="Description of Artificial Sequence: Synthetic oligonucleotide"
acaucgucacaguggcuucaa

SEQ ID NO: 3101 - RNA, 21 nt, Artificial Sequence
  source: /note="Description of Artificial Sequence: Synthetic oligonucleotide"
caucgucacaguggcuucagu

SEQ ID NO: 3102 - RNA, 21 nt, Artificial Sequence
  source: /note="Description of Artificial Sequence: Synthetic oligonucleotide"
aucgucacaguggcuucagua

SEQ ID NO: 3103 - RNA, 21 nt, Artificial Sequence
  source: /note="Description of Artificial Sequence: Synthetic oligonucleotide"
ucgucacaguggcuucagugu

SEQ ID NO: 3104 - RNA, 21 nt, Artificial Sequence
  source: /note="Description of Artificial Sequence: Synthetic oligonucleotide"
cggccacgaagggauuccuua

SEQ ID NO: 3105 - RNA, 21 nt, Artificial Sequence
  source: /note="Description of Artificial Sequence: Synthetic oligonucleotide"
ggccacgaagggauuccuuaa

SEQ ID NO: 3106 - RNA, 21 nt, Artificial Sequence
  source: /note="Description of Artificial Sequence: Synthetic oligonucleotide"
ccacgaagggauuccuuaccu

SEQ ID NO: 3107 - RNA, 21 nt, Artificial Sequence
  source: /note="Description of Artificial Sequence: Synthetic oligonucleotide"
cacgaagggauuccuuaccua

SEQ ID NO: 3108 - RNA, 21 nt, Artificial Sequence
  source: /note="Description of Artificial Sequence: Synthetic oligonucleotide"
acgaagggauuccuuaccuca

SEQ ID NO: 3109 - RNA, 21 nt, Artificial Sequence
  source: /note="Description of Artificial Sequence: Synthetic oligonucleotide"
gaagggauuccuuaccucaua

SEQ ID NO: 3110 - RNA, 21 nt, Artificial Sequence
  source: /note="Description of Artificial Sequence: Synthetic oligonucleotide"
aagggauuccuuaccucauca

SEQ ID NO: 3111 - RNA, 21 nt, Artificial Sequence
  source: /note="Description of Artificial Sequence: Synthetic oligonucleotide"
caucccauauuguuccagcaa

SEQ ID NO: 3112 - RNA, 21 nt, Artificial Sequence
  source: /note="Description of Artificial Sequence: Synthetic oligonucleotide"
guuccagcaaauuugccgcua

SEQ ID NO: 3113 - RNA, 21 nt, Artificial Sequence
  source: /note="Description of Artificial Sequence: Synthetic oligonucleotide"
auuugccgcuguuggcuuuca

SEQ ID NO: 3114 - RNA, 21 nt, Artificial Sequence
  source: /note="Description of Artificial Sequence: Synthetic oligonucleotide"
uuugccgcuguuggcuuucaa

SEQ ID NO: 3115 - RNA, 21 nt, Artificial Sequence
  source: /note="Description of Artificial Sequence: Synthetic oligonucleotide"
uugccgcuguuggcuuucaca

SEQ ID NO: 3116 - RNA, 21 nt, Artificial Sequence
  source: /note="Description of Artificial Sequence: Synthetic oligonucleotide"
gcuuucacagaggucugacau

SEQ ID NO: 3117 - RNA, 21 nt, Artificial Sequence
  source: /note="Description of Artificial Sequence: Synthetic oligonucleotide"
cacagaggucugacaucagaa

SEQ ID NO: 3118 - RNA, 21 nt, Artificial Sequence
  source: /note="Description of Artificial Sequence: Synthetic oligonucleotide"
aggucugacaucagaacuuca

SEQ ID NO: 3119 - RNA, 21 nt, Artificial Sequence
  source: /note="Description of Artificial Sequence: Synthetic oligonucleotide"
gccuugggaaaaacugguaua

SEQ ID NO: 3120 - RNA, 21 nt, Artificial Sequence
  source: /note="Description of Artificial Sequence: Synthetic oligonucleotide"
acugguaucaaaaccucaugu

SEQ ID NO: 3121 - RNA, 21 nt, Artificial Sequence
  source: /note="Description of Artificial Sequence: Synthetic oligonucleotide"
cugguaucaaaaccucaugua

SEQ ID NO: 3122 - RNA, 21 nt, Artificial Sequence
  source: /note="Description of Artificial Sequence: Synthetic oligonucleotide"
uuugugaauacuggguucaca

SEQ ID NO: 3123 - RNA, 21 nt, Artificial Sequence
  source: /note="Description of Artificial Sequence: Synthetic oligonucleotide"
uugugaauacuggguucacca

SEQ ID NO: 3124 - RNA, 21 nt, Artificial Sequence
  source: /note="Description of Artificial Sequence: Synthetic oligonucleotide"
ugugaauacuggguucaccaa

SEQ ID NO: 3125 - RNA, 21 nt, Artificial Sequence
  source: /note="Description of Artificial Sequence: Synthetic oligonucleotide"
aauacuggguucaccaaaaau

SEQ ID NO: 3126 - RNA, 21 nt, Artificial Sequence
  source: /note="Description of Artificial Sequence: Synthetic oligonucleotide"
auacuggguucaccaaaaaua

SEQ ID NO: 3127 - RNA, 21 nt, Artificial Sequence
  source: /note="Description of Artificial Sequence: Synthetic oligonucleotide"
uccaagcacaagauuauggca

SEQ ID NO: 3128 - RNA, 21 nt, Artificial Sequence
  source: /note="Description of Artificial Sequence: Synthetic oligonucleotide"
agcacaagauuauggccugua

SEQ ID NO: 3129 - RNA, 21 nt, Artificial Sequence
  source: /note="Description of Artificial Sequence: Synthetic oligonucleotide"
gcacaagauuauggccuguau

SEQ ID NO: 3130 - RNA, 21 nt, Artificial Sequence
  source: /note="Description of Artificial Sequence: Synthetic oligonucleotide"
cacaagauuauggccuguauu

SEQ ID NO: 3131 - RNA, 21 nt, Artificial Sequence
  source: /note="Description of Artificial Sequence: Synthetic oligonucleotide"
caagauuauggccuguauuga

SEQ ID NO: 3132 - RNA, 21 nt, Artificial Sequence
  source: /note="Description of Artificial Sequence: Synthetic oligonucleotide"
agauuauggccuguauuggaa

SEQ ID NO: 3133 - RNA, 21 nt, Artificial Sequence
  source: /note="Description of Artificial Sequence: Synthetic oligonucleotide"
auuauggccuguauuggagaa

SEQ ID NO: 3134 - RNA, 21 nt, Artificial Sequence
  source: /note="Description of Artificial Sequence: Synthetic oligonucleotide"
uuauggccuguauuggagaca

SEQ ID NO: 3135 - RNA, 21 nt, Artificial Sequence
  source: /note="Description of Artificial Sequence: Synthetic oligonucleotide"
uggccuguauuggagacagau

SEQ ID NO: 3136 - RNA, 21 nt, Artificial Sequence
  source: /note="Description of Artificial Sequence: Synthetic oligonucleotide"
ggccuguauuggagacagaua

SEQ ID NO: 3137 - RNA, 21 nt, Artificial Sequence
  source: /note="Description of Artificial Sequence: Synthetic oligonucleotide"
uuggagacagaugaagucgua

SEQ ID NO: 3138 - RNA, 21 nt, Artificial Sequence
  source: /note="Description of Artificial Sequence: Synthetic oligonucleotide"
acagaugaagucguaagaagu

SEQ ID NO: 3139 - RNA, 21 nt, Artificial Sequence
  source: /note="Description of Artificial Sequence: Synthetic oligonucleotide"
cagaugaagucguaagaagua

SEQ ID NO: 3140 - RNA, 21 nt, Artificial Sequence
  source: /note="Description of Artificial Sequence: Synthetic oligonucleotide"
agaugaagucguaagaagucu

SEQ ID NO: 3141 - RNA, 21 nt, Artificial Sequence
  source: /note="Description of Artificial Sequence: Synthetic oligonucleotide"
gaugaagucguaagaagucua

SEQ ID NO: 3142 - RNA, 21 nt, Artificial Sequence
  source: /note="Description of Artificial Sequence: Synthetic oligonucleotide"
gaagucguaagaagucugaua

SEQ ID NO: 3143 - RNA, 21 nt, Artificial Sequence
  source: /note="Description of Artificial Sequence: Synthetic oligonucleotide"
agucguaagaagucugauaga

SEQ ID NO: 3144 - RNA, 21 nt, Artificial Sequence
  source: /note="Description of Artificial Sequence: Synthetic oligonucleotide"
uaagaagucugauagauggaa

SEQ ID NO: 3145 - RNA, 21 nt, Artificial Sequence
  source: /note="Description of Artificial Sequence: Synthetic oligonucleotide"
aagaagucugauagauggaau

SEQ ID NO: 3146 - RNA, 21 nt, Artificial Sequence
  source: /note="Description of Artificial Sequence: Synthetic oligonucleotide"
gaagucugauagauggaauaa

SEQ ID NO: 3147 - RNA, 21 nt, Artificial Sequence
  source: /note="Description of Artificial Sequence: Synthetic oligonucleotide"
aagucugauagauggaauacu

SEQ ID NO: 3148 - RNA, 21 nt, Artificial Sequence
  source: /note="Description of Artificial Sequence: Synthetic oligonucleotide"
uggaauacuuaccaauaagaa

SEQ ID NO: 3149 - RNA, 21 nt, Artificial Sequence
  source: /note="Description of Artificial Sequence: Synthetic oligonucleotide"
aaugauuuuuguuccaucgua

SEQ ID NO: 3150 - RNA, 21 nt, Artificial Sequence
  source: /note="Description of Artificial Sequence: Synthetic oligonucleotide"
augauuuuuguuccaucguau

SEQ ID NO: 3151 - RNA, 21 nt, Artificial Sequence
  source: /note="Description of Artificial Sequence: Synthetic oligonucleotide"
auuuuuguuccaucguauaua

SEQ ID NO: 3152 - RNA, 21 nt, Artificial Sequence
  source: /note="Description of Artificial Sequence: Synthetic oligonucleotide"
uuguuccaucguauaucaaua

SEQ ID NO: 3153 - RNA, 21 nt, Artificial Sequence
  source: /note="Description of Artificial Sequence: Synthetic oligonucleotide"
guuccaucguauaucaauaua

SEQ ID NO: 3154 - RNA, 21 nt, Artificial Sequence
  source: /note="Description of Artificial Sequence: Synthetic oligonucleotide"
uuccaucguauaucaauaucu

SEQ ID NO: 3155 - RNA, 21 nt, Artificial Sequence
  source: /note="Description of Artificial Sequence: Synthetic oligonucleotide"
uccaucguauaucaauaucuu

SEQ ID NO: 3156 - RNA, 21 nt, Artificial Sequence
  source: /note="Description of Artificial Sequence: Synthetic oligonucleotide"
ccaucguauaucaauaucuuu

SEQ ID NO: 3157 - RNA, 21 nt, Artificial Sequence
  source: /note="Description of Artificial Sequence: Synthetic oligonucleotide"
acagaaguuucuuccugaaca

SEQ ID NO: 3158 - RNA, 21 nt, Artificial Sequence
  source: /note="Description of Artificial Sequence: Synthetic oligonucleotide"
agaaguuucuuccugaacgca

SEQ ID NO: 3159 - RNA, 21 nt, Artificial Sequence
  source: /note="Description of Artificial Sequence: Synthetic oligonucleotide"
aaguuucuuccugaacgcgca

SEQ ID NO: 3160 - RNA, 21 nt, Artificial Sequence
  source: /note="Description of Artificial Sequence: Synthetic oligonucleotide"
guuucuuccugaacgcgccua

SEQ ID NO: 3161 - RNA, 21 nt, Artificial Sequence
  source: /note="Description of Artificial Sequence: Synthetic oligonucleotide"
ucuuccugaacgcgccucaga

SEQ ID NO: 3162 - RNA, 21 nt, Artificial Sequence
  source: /note="Description of Artificial Sequence: Synthetic oligonucleotide"
ccucagcgauuuuaaaucgua

SEQ ID NO: 3163 - RNA, 21 nt, Artificial Sequence
  source: /note="Description of Artificial Sequence: Synthetic oligonucleotide"
cucagcgauuuuaaaucguau

SEQ ID NO: 3164 - RNA, 21 nt, Artificial Sequence
  source: /note="Description of Artificial Sequence: Synthetic oligonucleotide"
ucagcgauuuuaaaucguaua

SEQ ID NO: 3165 - RNA, 21 nt, Artificial Sequence
  source: /note="Description of Artificial Sequence: Synthetic oligonucleotide"
cagcgauuuuaaaucguauga

SEQ ID NO: 3166 - RNA, 21 nt, Artificial Sequence
  source: /note="Description of Artificial Sequence: Synthetic oligonucleotide"
agcgauuuuaaaucguaugca

SEQ ID NO: 3167 - RNA, 21 nt, Artificial Sequence
  source: /note="Description of Artificial Sequence: Synthetic oligonucleotide"
gcgauuuuaaaucguaugcaa

SEQ ID NO: 3168 - RNA, 21 nt, Artificial Sequence
  source: /note="Description of Artificial Sequence: Synthetic oligonucleotide"
cgauuuuaaaucguaugcaga

SEQ ID NO: 3169 - RNA, 21 nt, Artificial Sequence
  source: /note="Description of Artificial Sequence: Synthetic oligonucleotide"
gauuuuaaaucguaugcagaa

SEQ ID NO: 3170 - RNA, 21 nt, Artificial Sequence
  source: /note="Description of Artificial Sequence: Synthetic oligonucleotide"
auuuuaaaucguaugcagaau

SEQ ID NO: 3171 - RNA, 21 nt, Artificial Sequence
  source: /note="Description of Artificial Sequence: Synthetic oligonucleotide"
uuuuaaaucguaugcagaaua

SEQ ID NO: 3172 - RNA, 21 nt, Artificial Sequence
  source: /note="Description of Artificial Sequence: Synthetic oligonucleotide"
aaaucguaugcagaauauuca

SEQ ID NO: 3173 - RNA, 21 nt, Artificial Sequence
  source: /note="Description of Artificial Sequence: Synthetic oligonucleotide"
aucguaugcagaauauucaau

SEQ ID NO: 3174 - RNA, 21 nt, Artificial Sequence
  source: /note="Description of Artificial Sequence: Synthetic oligonucleotide"
uauucaauuugaagcaguggu

SEQ ID NO: 3175 - RNA, 21 nt, Artificial Sequence
  source: /note="Description of Artificial Sequence: Synthetic oligonucleotide"
gaauaaauaagcuccagccaa

SEQ ID NO: 3176 - RNA, 21 nt, Artificial Sequence
  source: /note="Description of Artificial Sequence: Synthetic oligonucleotide"
aauaaauaagcuccagccaga

SEQ ID NO: 3177 - RNA, 21 nt, Artificial Sequence
  source: /note="Description of Artificial Sequence: Synthetic oligonucleotide"
agccagagauguaugcaugau

SEQ ID NO: 3178 - RNA, 21 nt, Artificial Sequence
  source: /note="Description of Artificial Sequence: Synthetic oligonucleotide"
gccagagauguaugcaugaua

SEQ ID NO: 3179 - RNA, 21 nt, Artificial Sequence
  source: /note="Description of Artificial Sequence: Synthetic oligonucleotide"
auaugaauaguuucgaaucaa

SEQ ID NO: 3180 - RNA, 21 nt, Artificial Sequence
  source: /note="Description of Artificial Sequence: Synthetic oligonucleotide"
uaugaauaguuucgaaucaau

SEQ ID NO: 3181 - RNA, 21 nt, Artificial Sequence
  source: /note="Description of Artificial Sequence: Synthetic oligonucleotide"
aauaguuucgaaucaaugcua

SEQ ID NO: 3182 - RNA, 21 nt, Artificial Sequence
  source: /note="Description of Artificial Sequence: Synthetic oligonucleotide"
uucaguccugauaauauuaaa

SEQ ID NO: 3183 - RNA, 21 nt, Artificial Sequence
  source: /note="Description of Artificial Sequence: Synthetic oligonucleotide"
aaaaacauugguuuggcacua

SEQ ID NO: 3184 - RNA, 21 nt, Artificial Sequence
  source: /note="Description of Artificial Sequence: Synthetic oligonucleotide"
aaaacauugguuuggcacuaa

SEQ ID NO: 3185 - RNA, 21 nt, Artificial Sequence
  source: /note="Description of Artificial Sequence: Synthetic oligonucleotide"
gucaaacgaacaagauuaauu

SEQ ID NO: 3186 - RNA, 21 nt, Artificial Sequence
  source: /note="Description of Artificial Sequence: Synthetic oligonucleotide"
aaacgaacaagauuaauuaca

SEQ ID NO: 3187 - RNA, 21 nt, Artificial Sequence
  source: /note="Description of Artificial Sequence: Synthetic oligonucleotide"
aacgaacaagauuaauuaccu

SEQ ID NO: 3188 - RNA, 21 nt, Artificial Sequence
  source: /note="Description of Artificial Sequence: Synthetic oligonucleotide"
acgaacaagauuaauuaccua

SEQ ID NO: 3189 - RNA, 21 nt, Artificial Sequence
  source: /note="Description of Artificial Sequence: Synthetic oligonucleotide"
cgaacaagauuaauuaccugu

SEQ ID NO: 3190 - RNA, 21 nt, Artificial Sequence
  source: /note="Description of Artificial Sequence: Synthetic oligonucleotide"
ucucaagaauauuuacguagu

SEQ ID NO: 3191 - RNA, 21 nt, Artificial Sequence
  source: /note="Description of Artificial Sequence: Synthetic oligonucleotide"
ucaagaauauuuacguaguuu

SEQ ID NO: 3192 - RNA, 21 nt, Artificial Sequence
  source: /note="Description of Artificial Sequence: Synthetic oligonucleotide"
caagaauauuuacguaguuuu

SEQ ID NO: 3193 - RNA, 21 nt, Artificial Sequence
  source: /note="Description of Artificial Sequence: Synthetic oligonucleotide"
uuucauaggucuguuuuuccu

SEQ ID NO: 3194 - RNA, 21 nt, Artificial Sequence
  source: /note="Description of Artificial Sequence: Synthetic oligonucleotide"
uucaugccucuuaaaaacuua

SEQ ID NO: 3195 - RNA, 21 nt, Artificial Sequence
  source: /note="Description of Artificial Sequence: Synthetic oligonucleotide"
aaaaacuucugugcuuacaua

SEQ ID NO: 3196 - RNA, 21 nt, Artificial Sequence
  source: /note="Description of Artificial Sequence: Synthetic oligonucleotide"
aaaacuucugugcuuacauaa

SEQ ID NO: 3197 - RNA, 21 nt, Artificial Sequence
  source: /note="Description of Artificial Sequence: Synthetic oligonucleotide"
aaacuucugugcuuacauaaa

SEQ ID NO: 3198 - RNA, 21 nt, Artificial Sequence
  source: /note="Description of Artificial Sequence: Synthetic oligonucleotide"
uuuuuccauuuaaagguggaa

SEQ ID NO: 3199 - RNA, 21 nt, Artificial Sequence
  source: /note="Description of Artificial Sequence: Synthetic oligonucleotide"
cuaccucccuaaaaguaaaua

SEQ ID NO: 3200 - RNA, 21 nt, Artificial Sequence
  source: /note="Description of Artificial Sequence: Synthetic oligonucleotide"
uaccucccuaaaaguaaauaa

SEQ ID NO: 3201 - RNA, 21 nt, Artificial Sequence
  source: /note="Description of Artificial Sequence: Synthetic oligonucleotide"
uacaaagagaacuuauuuaca

SEQ ID NO: 3202 - RNA, 21 nt, Artificial Sequence
  source: /note="Description of Artificial Sequence: Synthetic oligonucleotide"
aacuuauuuacacagggaaga

SEQ ID NO: 3203 - RNA, 21 nt, Artificial Sequence
  source: /note="Description of Artificial Sequence: Synthetic oligonucleotide"
uuacacagggaagguuuaaga

SEQ ID NO: 3204 - RNA, 21 nt, Artificial Sequence
  source: /note="Description of Artificial Sequence: Synthetic oligonucleotide"
uacacagggaagguuuaagaa

SEQ ID NO: 3205 - RNA, 21 nt, Artificial Sequence
  source: /note="Description of Artificial Sequence: Synthetic oligonucleotide"
acacagggaagguuuaagacu

SEQ ID NO: 3206 - RNA, 21 nt, Artificial Sequence
  source: /note="Description of Artificial Sequence: Synthetic oligonucleotide"
agguuuaagacuguucaagua

SEQ ID NO: 3207 - RNA, 21 nt, Artificial Sequence
  source: /note="Description of Artificial Sequence: Synthetic oligonucleotide"
uuuaagacuguucaaguagca

SEQ ID NO: 3208 - RNA, 21 nt, Artificial Sequence
  source: /note="Description of Artificial Sequence: Synthetic oligonucleotide"
uaagacuguucaaguagcauu

SEQ ID NO: 3209 - RNA, 21 nt, Artificial Sequence
  source: /note="Description of Artificial Sequence: Synthetic oligonucleotide"
agacuguucaaguagcauuca

SEQ ID NO: 3210 - RNA, 21 nt, Artificial Sequence
  source: /note="Description of Artificial Sequence: Synthetic oligonucleotide"
cuguucaaguagcauuccaau

SEQ ID NO: 3211 - RNA, 21 nt, Artificial Sequence
  source: /note="Description of Artificial Sequence: Synthetic oligonucleotide"
guucaaguagcauuccaaucu

SEQ ID NO: 3212 - RNA, 21 nt, Artificial Sequence
  source: /note="Description of Artificial Sequence: Synthetic oligonucleotide"
uucaaguagcauuccaaucua

SEQ ID NO: 3213 - RNA, 21 nt, Artificial Sequence
  source: /note="Description of Artificial Sequence: Synthetic oligonucleotide"
uagcauuccaaucuguagcca

SEQ ID NO: 3214 - RNA, 21 nt, Artificial Sequence
  source: /note="Description of Artificial Sequence: Synthetic oligonucleotide"
agcauuccaaucuguagccau

SEQ ID NO: 3215 - RNA, 21 nt, Artificial Sequence
  source: /note="Description of Artificial Sequence: Synthetic oligonucleotide"
gcauuccaaucuguagccaua

SEQ ID NO: 3216 - RNA, 21 nt, Artificial Sequence
  source: /note="Description of Artificial Sequence: Synthetic oligonucleotide"
gccaugccacagaauaucaaa

SEQ ID NO: 3217 - RNA, 21 nt, Artificial Sequence
  source: /note="Description of Artificial Sequence: Synthetic oligonucleotide"
ccaugccacagaauaucaaca

SEQ ID NO: 3218 - RNA, 21 nt, Artificial Sequence
  source: /note="Description of Artificial Sequence: Synthetic oligonucleotide"
aagaacacagaaugagugcaa

SEQ ID NO: 3219 - RNA, 21 nt, Artificial Sequence
  source: /note="Description of Artificial Sequence: Synthetic oligonucleotide"
guuucagcaggcagcuuuaua

SEQ ID NO: 3220 - RNA, 21 nt, Artificial Sequence
  source: /note="Description of Artificial Sequence: Synthetic oligonucleotide"
uuucagcaggcagcuuuaucu

SEQ ID NO: 3221 - RNA, 21 nt, Artificial Sequence
  source: /note="Description of Artificial Sequence: Synthetic oligonucleotide"
gcagcuuuaucucaaccugga

SEQ ID NO: 3222 - RNA, 21 nt, Artificial Sequence
  source: /note="Description of Artificial Sequence: Synthetic oligonucleotide"
aucucaaccuggacauauuuu

SEQ ID NO: 3223 - RNA, 21 nt, Artificial Sequence
  source: /note="Description of Artificial Sequence: Synthetic oligonucleotide"
auuugaaagauuucccuagca

SEQ ID NO: 3224 - RNA, 21 nt, Artificial Sequence
  source: /note="Description of Artificial Sequence: Synthetic oligonucleotide"
uugaaagauuucccuagccua

SEQ ID NO: 3225 - RNA, 21 nt, Artificial Sequence
  source: /note="Description of Artificial Sequence: Synthetic oligonucleotide"
ugaaagauuucccuagccucu

SEQ ID NO: 3226 - RNA, 21 nt, Artificial Sequence
  source: /note="Description of Artificial Sequence: Synthetic oligonucleotide"
gaaagauuucccuagccucuu

SEQ ID NO: 3227 - RNA, 21 nt, Artificial Sequence
  source: /note="Description of Artificial Sequence: Synthetic oligonucleotide"
cauuagcccaaaacggugcaa

SEQ ID NO: 3228 - RNA, 21 nt, Artificial Sequence
  source: /note="Description of Artificial Sequence: Synthetic oligonucleotide"
auuagcccaaaacggugcaaa

SEQ ID NO: 3229 - RNA, 21 nt, Artificial Sequence
  source: /note="Description of Artificial Sequence: Synthetic oligonucleotide"
uuagcccaaaacggugcaacu

SEQ ID NO: 3230 - RNA, 21 nt, Artificial Sequence
  source: /note="Description of Artificial Sequence: Synthetic oligonucleotide"
uagcccaaaacggugcaacua

SEQ ID NO: 3231 - RNA, 21 nt, Artificial Sequence
  source: /note="Description of Artificial Sequence: Synthetic oligonucleotide"
agcccaaaacggugcaacucu

SEQ ID NO: 3232 - RNA, 21 nt, Artificial Sequence
  source: /note="Description of Artificial Sequence: Synthetic oligonucleotide"
gcccaaaacggugcaacucua

SEQ ID NO: 3233 - RNA, 21 nt, Artificial Sequence
  source: /note="Description of Artificial Sequence: Synthetic oligonucleotide"
ccaaaacggugcaacucuauu

SEQ ID NO: 3234 - RNA, 21 nt, Artificial Sequence
  source: /note="Description of Artificial Sequence: Synthetic oligonucleotide"
aaaacggugcaacucuauucu

SEQ ID NO: 3235 - RNA, 21 nt, Artificial Sequence
  source: /note="Description of Artificial Sequence: Synthetic oligonucleotide"
aaacggugcaacucuauucua

SEQ ID NO: 3236 - RNA, 21 nt, Artificial Sequence
  source: /note="Description of Artificial Sequence: Synthetic oligonucleotide"
aacggugcaacucuauucuga

SEQ ID NO: 3237 - RNA, 21 nt, Artificial Sequence
  source: /note="Description of Artificial Sequence: Synthetic oligonucleotide"
ggugcaacucuauucuggacu

SEQ ID NO: 3238 - RNA, 21 nt, Artificial Sequence
  source: /note="Description of Artificial Sequence: Synthetic oligonucleotide"
ugcaacucuauucuggacuuu

SEQ ID NO: 3239 - RNA, 21 nt, Artificial Sequence
  source: /note="Description of Artificial Sequence: Synthetic oligonucleotide"
caacucuauucuggacuuuau

SEQ ID NO: 3240 - RNA, 21 nt, Artificial Sequence
  source: /note="Description of Artificial Sequence: Synthetic oligonucleotide"
aacucuauucuggacuuuauu

SEQ ID NO: 3241 - RNA, 21 nt, Artificial Sequence
  source: /note="Description of Artificial Sequence: Synthetic oligonucleotide"
auucuggacuuuauuacuuga

SEQ ID NO: 3242 - RNA, 21 nt, Artificial Sequence
  source: /note="Description of Artificial Sequence: Synthetic oligonucleotide"
uguauaacucugaaguccaca

SEQ ID NO: 3243 - RNA, 21 nt, Artificial Sequence
  source: /note="Description of Artificial Sequence: Synthetic oligonucleotide"
guauaacucugaaguccacca

SEQ ID NO: 3244 - RNA, 21 nt, Artificial Sequence
  source: /note="Description of Artificial Sequence: Synthetic oligonucleotide"
gaaguccaccaaaaguggaca

SEQ ID NO: 3245 - RNA, 21 nt, Artificial Sequence
  source: /note="Description of Artificial Sequence: Synthetic oligonucleotide"
guccaccaaaaguggacccua

SEQ ID NO: 3246 - RNA, 21 nt, Artificial Sequence
  source: /note="Description of Artificial Sequence: Synthetic oligonucleotide"
caccaaaaguggacccucuau

SEQ ID NO: 3247 - RNA, 21 nt, Artificial Sequence
  source: /note="Description of Artificial Sequence: Synthetic oligonucleotide"
accaaaaguggacccucuaua

SEQ ID NO: 3248 - RNA, 21 nt, Artificial Sequence
  source: /note="Description of Artificial Sequence: Synthetic oligonucleotide"
ccaaaaguggacccucuauau

SEQ ID NO: 3249 - RNA, 21 nt, Artificial Sequence
  source: /note="Description of Artificial Sequence: Synthetic oligonucleotide"
aaaaguggacccucuauauuu

SEQ ID NO: 3250 - RNA, 21 nt, Artificial Sequence
  source: /note="Description of Artificial Sequence: Synthetic oligonucleotide"
aaaguggacccucuauauuua

SEQ ID NO: 3251 - RNA, 21 nt, Artificial Sequence
  source: /note="Description of Artificial Sequence: Synthetic oligonucleotide"
aaguggacccucuauauuuca

SEQ ID NO: 3252 - RNA, 21 nt, Artificial Sequence
  source: /note="Description of Artificial Sequence: Synthetic oligonucleotide"
auacauuaugaaaggugacca

SEQ ID NO: 3253 - RNA, 21 nt, Artificial Sequence
  source: /note="Description of Artificial Sequence: Synthetic oligonucleotide"
uacauuaugaaaggugaccga

SEQ ID NO: 3254 - RNA, 21 nt, Artificial Sequence
  source: /note="Description of Artificial Sequence: Synthetic oligonucleotide"
acauuaugaaaggugaccgaa

SEQ ID NO: 3255 - RNA, 21 nt, Artificial Sequence
  source: /note="Description of Artificial Sequence: Synthetic oligonucleotide"
cauuaugaaaggugaccgacu

SEQ ID NO: 3256 - RNA, 21 nt, Artificial Sequence
  source: /note="Description of Artificial Sequence: Synthetic oligonucleotide"
auuaugaaaggugaccgacua

SEQ ID NO: 3257 - RNA, 21 nt, Artificial Sequence
  source: /note="Description of Artificial Sequence: Synthetic oligonucleotide"
aggugaccgacucuauuuuaa

SEQ ID NO: 3258 - RNA, 21 nt, Artificial Sequence
  source: /note="Description of Artificial Sequence: Synthetic oligonucleotide"
aucucagaauuuuaaguucua

SEQ ID NO: 3259 - RNA, 21 nt, Artificial Sequence
  source: /note="Description of Artificial Sequence: Synthetic oligonucleotide"
cuuucauauauccuuggucca

SEQ ID NO: 3260 - RNA, 21 nt, Artificial Sequence
  source: /note="Description of Artificial Sequence: Synthetic oligonucleotide"
uuucauauauccuugguccca

SEQ ID NO: 3261 - RNA, 21 nt, Artificial Sequence
  source: /note="Description of Artificial Sequence: Synthetic oligonucleotide"
uucauauauccuuggucccaa

SEQ ID NO: 3262 - RNA, 21 nt, Artificial Sequence
  source: /note="Description of Artificial Sequence: Synthetic oligonucleotide"
gucccagagauguuuagacaa

SEQ ID NO: 3263 - RNA, 21 nt, Artificial Sequence
  source: /note="Description of Artificial Sequence: Synthetic oligonucleotide"
cagagauguuuagacaauuuu

SEQ ID NO: 3264 - RNA, 21 nt, Artificial Sequence
  source: /note="Description of Artificial Sequence: Synthetic oligonucleotide"
agagauguuuagacaauuuua

SEQ ID NO: 3265 - RNA, 21 nt, Artificial Sequence
  source: /note="Description of Artificial Sequence: Synthetic oligonucleotide"
guuuagacaauuuuaggcuca

SEQ ID NO: 3266 - RNA, 21 nt, Artificial Sequence
  source: /note="Description of Artificial Sequence: Synthetic oligonucleotide"
uuuagacaauuuuaggcucaa

SEQ ID NO: 3267 - RNA, 21 nt, Artificial Sequence
  source: /note="Description of Artificial Sequence: Synthetic oligonucleotide"
uuagacaauuuuaggcucaaa

SEQ ID NO: 3268 - RNA, 21 nt, Artificial Sequence
  source: /note="Description of Artificial Sequence: Synthetic oligonucleotide"
uagacaauuuuaggcucaaaa

SEQ ID NO: 3269 - RNA, 21 nt, Artificial Sequence
  source: /note="Description of Artificial Sequence: Synthetic oligonucleotide"
agacaauuuuaggcucaaaaa

SEQ ID NO: 3270 - RNA, 21 nt, Artificial Sequence
  source: /note="Description of Artificial Sequence: Synthetic oligonucleotide"
acaauuuuaggcucaaaaauu

SEQ ID NO: 3271 - RNA, 21 nt, Artificial Sequence
  source: /note="Description of Artificial Sequence: Synthetic oligonucleotide"
uuuaggcucaaaaauuaaaga

SEQ ID NO: 3272 - RNA, 21 nt, Artificial Sequence
  source: /note="Description of Artificial Sequence: Synthetic oligonucleotide"
uuaggcucaaaaauuaaagcu

SEQ ID NO: 3273 - RNA, 21 nt, Artificial Sequence
  source: /note="Description of Artificial Sequence: Synthetic oligonucleotide"
uaggcucaaaaauuaaagcua

SEQ ID NO: 3274 - RNA, 21 nt, Artificial Sequence
  source: /note="Description of Artificial Sequence: Synthetic oligonucleotide"
caggaaaaggaacuguacuga

SEQ ID NO: 3275 - RNA, 21 nt, Artificial Sequence
  source: /note="Description of Artificial Sequence: Synthetic oligonucleotide"
ggaaaaggaacuguacuggcu

SEQ ID NO: 3276 - RNA, 21 nt, Artificial Sequence
  source: /note="Description of Artificial Sequence: Synthetic oligonucleotide"
aaaaggaacuguacuggcuau

SEQ ID NO: 3277 - RNA, 21 nt, Artificial Sequence
  source: /note="Description of Artificial Sequence: Synthetic oligonucleotide"
aggaacuguacuggcuauuaa

SEQ ID NO: 3278 - RNA, 21 nt, Artificial Sequence
  source: /note="Description of Artificial Sequence: Synthetic oligonucleotide"
ggaacuguacuggcuauuaca

SEQ ID NO: 3279 - RNA, 21 nt, Artificial Sequence
  source: /note="Description of Artificial Sequence: Synthetic oligonucleotide"
uaauccgacucccacuacaua

SEQ ID NO: 3280 - RNA, 21 nt, Artificial Sequence
  source: /note="Description of Artificial Sequence: Synthetic oligonucleotide"
uccgacucccacuacaucaaa

SEQ ID NO: 3281 - RNA, 21 nt, Artificial Sequence
  source: /note="Description of Artificial Sequence: Synthetic oligonucleotide"
cucccacuacaucaagacuaa

SEQ ID NO: 3282 - RNA, 21 nt, Artificial Sequence
  source: /note="Description of Artificial Sequence: Synthetic oligonucleotide"
ucccacuacaucaagacuaau

SEQ ID NO: 3283 - RNA, 21 nt, Artificial Sequence
  source: /note="Description of Artificial Sequence: Synthetic oligonucleotide"
cccacuacaucaagacuaaua

SEQ ID NO: 3284 - RNA, 21 nt, Artificial Sequence
  source: /note="Description of Artificial Sequence: Synthetic oligonucleotide"
ccacuacaucaagacuaaucu

SEQ ID NO: 3285 - RNA, 21 nt, Artificial Sequence
  source: /note="Description of Artificial Sequence: Synthetic oligonucleotide"
acuacaucaagacuaaucuua

SEQ ID NO: 3286 - RNA, 21 nt, Artificial Sequence
  source: /note="Description of Artificial Sequence: Synthetic oligonucleotide"
cuacaucaagacuaaucuugu

SEQ ID NO: 3287 - RNA, 21 nt, Artificial Sequence
  source: /note="Description of Artificial Sequence: Synthetic oligonucleotide"
uacaucaagacuaaucuuguu

SEQ ID NO: 3288 - RNA, 21 nt, Artificial Sequence
  source: /note="Description of Artificial Sequence: Synthetic oligonucleotide"
acaucaagacuaaucuuguuu

SEQ ID NO: 3289 - RNA, 21 nt, Artificial Sequence
  source: /note="Description of Artificial Sequence: Synthetic oligonucleotide"
guauuauagaaugcuuuugca

SEQ ID NO: 3290 - RNA, 21 nt, Artificial Sequence
  source: /note="Description of Artificial Sequence: Synthetic oligonucleotide"
uauagaaugcuuuugcaugga

SEQ ID NO: 3291 - RNA, 21 nt, Artificial Sequence
  source: /note="Description of Artificial Sequence: Synthetic oligonucleotide"
agaaugcuuuugcauggacua

SEQ ID NO: 3292 - RNA, 21 nt, Artificial Sequence
  source: /note="Description of Artificial Sequence: Synthetic oligonucleotide"
gaaugcuuuugcauggacuau

SEQ ID NO: 3293 - RNA, 21 nt, Artificial Sequence
  source: /note="Description of Artificial Sequence: Synthetic oligonucleotide"
ugcuuuugcauggacuauccu

SEQ ID NO: 3294 - RNA, 21 nt, Artificial Sequence
  source: /note="Description of Artificial Sequence: Synthetic oligonucleotide"
cuuuugcauggacuauccucu

SEQ ID NO: 3295 - RNA, 21 nt, Artificial Sequence
  source: /note="Description of Artificial Sequence: Synthetic oligonucleotide"
ugcauggacuauccucuuguu

SEQ ID NO: 3296 - RNA, 21 nt, Artificial Sequence
  source: /note="Description of Artificial Sequence: Synthetic oligonucleotide"
gcauggacuauccucuuguuu

SEQ ID NO: 3297 - RNA, 21 nt, Artificial Sequence
  source: /note="Description of Artificial Sequence: Synthetic oligonucleotide"
aaauaaccucuuguaguuaua

SEQ ID NO: 3298 - RNA, 21 nt, Artificial Sequence
  source: /note="Description of Artificial Sequence: Synthetic oligonucleotide"
aaccucuuguaguuauaaaau

SEQ ID NO: 3299 - RNA, 23 nt, Artificial Sequence
  source: /note="Description of Artificial Sequence: Synthetic oligonucleotide"
aguccuagggaggagguacuguc

SEQ ID NO: 3300 - RNA, 23 nt, Artificial Sequence
  source: /note="Description of Artificial Sequence: Synthetic oligonucleotide"
uaguccuagggaggagguacugu

SEQ ID NO: 3301 - RNA, 23 nt, Artificial Sequence
  source: /note="Description of Artificial Sequence: Synthetic oligonucleotide"
uuaguccuagggaggagguacug

SEQ ID NO: 3302 - RNA, 23 nt, Artificial Sequence
  source: /note="Description of Artificial Sequence: Synthetic oligonucleotide"
uugguucaguccuuguguagucc

SEQ ID NO: 3303 - RNA, 23 nt, Artificial Sequence
  source: /note="Description of Artificial Sequence: Synthetic oligonucleotide"
ucugguucaguccuuguguaguc

SEQ ID NO: 3304 - RNA, 23 nt, Artificial Sequence
  source: /note="Description of Artificial Sequence: Synthetic oligonucleotide"
uuucugguucaguccuuguguag

SEQ ID NO: 3305 - RNA, 23 nt, Artificial Sequence
  source: /note="Description of Artificial Sequence: Synthetic oligonucleotide"
uauguucauggcuuugcucuguc

SEQ ID NO: 3306 - RNA, 23 nt, Artificial Sequence
  source: /note="Description of Artificial Sequence: Synthetic oligonucleotide"
ucagaaggauuucuaggaugaug

SEQ ID NO: 3307 - RNA, 23 nt, Artificial Sequence
  source: /note="Description of Artificial Sequence: Synthetic oligonucleotide"
uggugaucagaagcagaaggauu

SEQ ID NO: 3308 - RNA, 23 nt, Artificial Sequence
  source: /note="Description of Artificial Sequence: Synthetic oligonucleotide"
ucaaguaggaguagaugauggug

SEQ ID NO: 3309 - RNA, 23 nt, Artificial Sequence
  source: /note="Description of Artificial Sequence: Synthetic oligonucleotide"
acgacuccaaguaggaguagaug

SEQ ID NO: 3310 - RNA, 23 nt, Artificial Sequence
  source: /note="Description of Artificial Sequence: Synthetic oligonucleotide"
aacgacuccaaguaggaguagau

SEQ ID NO: 3311 - RNA, 23 nt, Artificial Sequence
  source: /note="Description of Artificial Sequence: Synthetic oligonucleotide"
uaacgacuccaaguaggaguaga

SEQ ID NO: 3312 - RNA, 23 nt, Artificial Sequence
  source: /note="Description of Artificial Sequence: Synthetic oligonucleotide"
ucaacgacuccaaguaggaguag

SEQ ID NO: 3313 - RNA, 23 nt, Artificial Sequence
  source: /note="Description of Artificial Sequence: Synthetic oligonucleotide"
accaacgacuccaaguaggagua

SEQ ID NO: 3314 - RNA, 23 nt, Artificial Sequence
  source: /note="Description of Artificial Sequence: Synthetic oligonucleotide"
uaccaacgacuccaaguaggagu

SEQ ID NO: 3315 - RNA, 23 nt, Artificial Sequence
  source: /note="Description of Artificial Sequence: Synthetic oligonucleotide"
augaaaaacuucaccaacgacuc

SEQ ID NO: 3316 - RNA, 23 nt, Artificial Sequence
  source: /note="Description of Artificial Sequence: Synthetic oligonucleotide"
uccaguaaugagaacaaucuccc

SEQ ID NO: 3317 - RNA, 23 nt, Artificial Sequence
  source: /note="Description of Artificial Sequence: Synthetic oligonucleotide"
uagcuccaguaaugagaacaauc

SEQ ID NO: 3318 - RNA, 23 nt, Artificial Sequence
  source: /note="Description of Artificial Sequence: Synthetic oligonucleotide"
ucaaauucauaaguagucugccu

SEQ ID NO: 3319 - RNA, 23 nt, Artificial Sequence
  source: /note="Description of Artificial Sequence: Synthetic oligonucleotide"
ucguuuugcaaauucauaaguag

SEQ ID NO: 3320 - RNA, 23 nt, Artificial Sequence
  source: /note="Description of Artificial Sequence: Synthetic oligonucleotide"
augcucugucguuuugcaaauuc

SEQ ID NO: 3321 - RNA, 23 nt, Artificial Sequence
  source: /note="Description of Artificial Sequence: Synthetic oligonucleotide"
uaugcucugucguuuugcaaauu

SEQ ID NO: 3322 - RNA, 23 nt, Artificial Sequence
  source: /note="Description of Artificial Sequence: Synthetic oligonucleotide"
ucacagaaccaauaugcucuguc

SEQ ID NO: 3323 - RNA, 23 nt, Artificial Sequence
  source: /note="Description of Artificial Sequence: Synthetic oligonucleotide"
uccacagaaccaauaugcucugu

SEQ ID NO: 3324 - RNA, 23 nt, Artificial Sequence
  source: /note="Description of Artificial Sequence: Synthetic oligonucleotide"
ucccacagaaccaauaugcucug

SEQ ID NO: 3325 - RNA, 23 nt, Artificial Sequence
  source: /note="Description of Artificial Sequence: Synthetic oligonucleotide"
ucgcuuauuaauaucccacagaa

SEQ ID NO: 3326 - RNA, 23 nt, Artificial Sequence
  source: /note="Description of Artificial Sequence: Synthetic oligonucleotide"
uuccacaccgcgcuuauuaauau

SEQ ID NO: 3327 - RNA, 23 nt, Artificial Sequence
  source: /note="Description of Artificial Sequence: Synthetic oligonucleotide"
ucuccacaccgcgcuuauuaaua

SEQ ID NO: 3328 - RNA, 23 nt, Artificial Sequence
  source: /note="Description of Artificial Sequence: Synthetic oligonucleotide"
uucggcacucagcugcaguuucc

SEQ ID NO: 3329 - RNA, 23 nt, Artificial Sequence
  source: /note="Description of Artificial Sequence: Synthetic oligonucleotide"
uuucggcacucagcugcaguuuc

SEQ ID NO: 3330 - RNA, 23 nt, Artificial Sequence
  source: /note="Description of Artificial Sequence: Synthetic oligonucleotide"
uuuucggcacucagcugcaguuu

SEQ ID NO: 3331 - RNA, 23 nt, Artificial Sequence
  source: /note="Description of Artificial Sequence: Synthetic oligonucleotide"
guuuucggcacucagcugcaguu

SEQ ID NO: 3332 - RNA, 23 nt, Artificial Sequence
  source: /note="Description of Artificial Sequence: Synthetic oligonucleotide"
aguuuucggcacucagcugcagu

SEQ ID NO: 3333 - RNA, 23 nt, Artificial Sequence
  source: /note="Description of Artificial Sequence: Synthetic oligonucleotide"
uaguuuucggcacucagcugcag

SEQ ID NO: 3334 - RNA, 23 nt, Artificial Sequence
  source: /note="Description of Artificial Sequence: Synthetic oligonucleotide"
uuaguuuucggcacucagcugca

SEQ ID NO: 3335 - RNA, 23 nt, Artificial Sequence
  source: /note="Description of Artificial Sequence: Synthetic oligonucleotide"
uccuaguuuucggcacucagcug

SEQ ID NO: 3336 - RNA, 23 nt, Artificial Sequence
  source: /note="Description of Artificial Sequence: Synthetic oligonucleotide"
ugccuaguuuucggcacucagcu

SEQ ID NO: 3337 - RNA, 23 nt, Artificial Sequence
  source: /note="Description of Artificial Sequence: Synthetic oligonucleotide"
acgccuaguuuucggcacucagc

SEQ ID NO: 3338 - RNA, 23 nt, Artificial Sequence
  source: /note="Description of Artificial Sequence: Synthetic oligonucleotide"
uacgccuaguuuucggcacucag

SEQ ID NO: 3339 - RNA, 23 nt, Artificial Sequence
  source: /note="Description of Artificial Sequence: Synthetic oligonucleotide"
ugacgccuaguuuucggcacuca

SEQ ID NO: 3340 - RNA, 23 nt, Artificial Sequence
  source: /note="Description of Artificial Sequence: Synthetic oligonucleotide"
uugacgccuaguuuucggcacuc

SEQ ID NO: 3341 - RNA, 23 nt, Artificial Sequence
  source: /note="Description of Artificial Sequence: Synthetic oligonucleotide"
agugacgccuaguuuucggcacu

SEQ ID NO: 3342 - RNA, 23 nt, Artificial Sequence
  source: /note="Description of Artificial Sequence: Synthetic oligonucleotide"
uagugacgccuaguuuucggcac

SEQ ID NO: 3343 - RNA, 23 nt, Artificial Sequence
  source: /note="Description of Artificial Sequence: Synthetic oligonucleotide"
ucagugacgccuaguuuucggca

SEQ ID NO: 3344 - RNA, 23 nt, Artificial Sequence
  source: /note="Description of Artificial Sequence: Synthetic oligonucleotide"
ugcagugacgccuaguuuucggc

SEQ ID NO: 3345 - RNA, 23 nt, Artificial Sequence
  source: /note="Description of Artificial Sequence: Synthetic oligonucleotide"
ugcgcagugacgccuaguuuucg

SEQ ID NO: 3346 - RNA, 23 nt, Artificial Sequence
  source: /note="Description of Artificial Sequence: Synthetic oligonucleotide"
uaugcgcagugacgccuaguuuu

SEQ ID NO: 3347 - RNA, 23 nt, Artificial Sequence
  source: /note="Description of Artificial Sequence: Synthetic oligonucleotide"
ucaugcgcagugacgccuaguuu

SEQ ID NO: 3348 - RNA, 23 nt, Artificial Sequence
  source: /note="Description of Artificial Sequence: Synthetic oligonucleotide"
auacgcaugcgcagugacgccua

SEQ ID NO: 3349 - RNA, 23 nt, Artificial Sequence
  source: /note="Description of Artificial Sequence: Synthetic oligonucleotide"
uagucuaccacauacgcaugcgc

SEQ ID NO: 3350 - RNA, 23 nt, Artificial Sequence
  source: /note="Description of Artificial Sequence: Synthetic oligonucleotide"
ucagucuaccacauacgcaugcg

SEQ ID NO: 3351 - RNA, 23 nt, Artificial Sequence
  source: /note="Description of Artificial Sequence: Synthetic oligonucleotide"
ucgauagaucucuucucuguugc

SEQ ID NO: 3352 - RNA, 23 nt, Artificial Sequence
  source: /note="Description of Artificial Sequence: Synthetic oligonucleotide"
agcgauagaucucuucucuguug

SEQ ID NO: 3353 - RNA, 23 nt, Artificial Sequence
  source: /note="Description of Artificial Sequence: Synthetic oligonucleotide"
uagcgauagaucucuucucuguu

SEQ ID NO: 3354 - RNA, 23 nt, Artificial Sequence
  source: /note="Description of Artificial Sequence: Synthetic oligonucleotide"
agagcgauagaucucuucucugu

SEQ ID NO: 3355 - RNA, 23 nt, Artificial Sequence
  source: /note="Description of Artificial Sequence: Synthetic oligonucleotide"
uagagcgauagaucucuucucug

SEQ ID NO: 3356 - RNA, 23 nt, Artificial Sequence
  source: /note="Description of Artificial Sequence: Synthetic oligonucleotide"
uagagagcgauagaucucuucuc

SEQ ID NO: 3357 - RNA, 23 nt, Artificial Sequence
  source: /note="Description of Artificial Sequence: Synthetic oligonucleotide"
uuagagagcgauagaucucuucu

SEQ ID NO: 3358 - RNA, 23 nt, Artificial Sequence
  source: /note="Description of Artificial Sequence: Synthetic oligonucleotide"
uuuagagagcgauagaucucuuc

SEQ ID NO: 3359 - RNA, 23 nt, Artificial Sequence
  source: /note="Description of Artificial Sequence: Synthetic oligonucleotide"
ugauuuagagagcgauagaucuc

SEQ ID NO: 3360 - RNA, 23 nt, Artificial Sequence
  source: /note="Description of Artificial Sequence: Synthetic oligonucleotide"
uugauuuagagagcgauagaucu

SEQ ID NO: 3361 - RNA, 23 nt, Artificial Sequence
  source: /note="Description of Artificial Sequence: Synthetic oligonucleotide"
accugauuuagagagcgauagau

SEQ ID NO: 3362 - RNA, 23 nt, Artificial Sequence
  source: /note="Description of Artificial Sequence: Synthetic oligonucleotide"
uaccugauuuagagagcgauaga

SEQ ID NO: 3363 - RNA, 23 nt, Artificial Sequence
  source: /note="Description of Artificial Sequence: Synthetic oligonucleotide"
ucaccugauuuagagagcgauag

SEQ ID NO: 3364 - RNA, 23 nt, Artificial Sequence
  source: /note="Description of Artificial Sequence: Synthetic oligonucleotide"
auucaccacgauuguuacaucac

SEQ ID NO: 3365 - RNA, 23 nt, Artificial Sequence
  source: /note="Description of Artificial Sequence: Synthetic oligonucleotide"
uauucaccacgauuguuacauca

SEQ ID NO: 3366 - RNA, 23 nt, Artificial Sequence
  source: /note="Description of Artificial Sequence: Synthetic oligonucleotide"
uuauucaccacgauuguuacauc

SEQ ID NO: 3367 - RNA, 23 nt, Artificial Sequence
  source: /note="Description of Artificial Sequence: Synthetic oligonucleotide"
auuauucaccacgauuguuacau

SEQ ID NO: 3368 - RNA, 23 nt, Artificial Sequence
  source: /note="Description of Artificial Sequence: Synthetic oligonucleotide"
acugucccagcauuauucaccac

SEQ ID NO: 3369 - RNA, 23 nt, Artificial Sequence
  source: /note="Description of Artificial Sequence: Synthetic oligonucleotide"
uuggauauacugucccagcauua

SEQ ID NO: 3370 - RNA, 23 nt, Artificial Sequence
  source: /note="Description of Artificial Sequence: Synthetic oligonucleotide"
ucuggauauacugucccagcauu

SEQ ID NO: 3371 - RNA, 23 nt, Artificial Sequence
  source: /note="Description of Artificial Sequence: Synthetic oligonucleotide"
ugcuggauauacugucccagcau

SEQ ID NO: 3372 - RNA, 23 nt, Artificial Sequence
  source: /note="Description of Artificial Sequence: Synthetic oligonucleotide"
ucggcuggauauacugucccagc

SEQ ID NO: 3373 - RNA, 23 nt, Artificial Sequence
  source: /note="Description of Artificial Sequence: Synthetic oligonucleotide"
aucggcuggauauacugucccag

SEQ ID NO: 3374 - RNA, 23 nt, Artificial Sequence
  source: /note="Description of Artificial Sequence: Synthetic oligonucleotide"
uaucggcuggauauacuguccca

SEQ ID NO: 3375 - RNA, 23 nt, Artificial Sequence
  source: /note="Description of Artificial Sequence: Synthetic oligonucleotide"
uaagaucggcuggauauacuguc

SEQ ID NO: 3376 - RNA, 23 nt, Artificial Sequence
  source: /note="Description of Artificial Sequence: Synthetic oligonucleotide"
uuuggugcugagaagaucggcug

SEQ ID NO: 3377 - RNA, 23 nt, Artificial Sequence
  source: /note="Description of Artificial Sequence: Synthetic oligonucleotide"
ucauccuuggugcugagaagauc

SEQ ID NO: 3378 - RNA, 23 nt, Artificial Sequence
  source: /note="Description of Artificial Sequence: Synthetic oligonucleotide"
ugguaaucucuucauccuuggug

SEQ ID NO: 3379 - RNA, 23 nt, Artificial Sequence
  source: /note="Description of Artificial Sequence: Synthetic oligonucleotide"
uaccucaaaugucuugguaaucu

SEQ ID NO: 3380 - RNA, 23 nt, Artificial Sequence
  source: /note="Description of Artificial Sequence: Synthetic oligonucleotide"
uguugaccucaaaugucuuggua

SEQ ID NO: 3381 - RNA, 23 nt, Artificial Sequence
  source: /note="Description of Artificial Sequence: Synthetic oligonucleotide"
uauguugaccucaaaugucuugg

SEQ ID NO: 3382 - RNA, 23 nt, Artificial Sequence
  source: /note="Description of Artificial Sequence: Synthetic oligonucleotide"
uuaggauguugaccucaaauguc

SEQ ID NO: 3383 - RNA, 23 nt, Artificial Sequence
  source: /note="Description of Artificial Sequence: Synthetic oligonucleotide"
ucuaggauguugaccucaaaugu

SEQ ID NO: 3384 - RNA, 23 nt, Artificial Sequence
  source: /note="Description of Artificial Sequence: Synthetic oligonucleotide"
aaauguccuaggauguugaccuc

SEQ ID NO: 3385 - RNA, 23 nt, Artificial Sequence
  source: /note="Description of Artificial Sequence: Synthetic oligonucleotide"
aaaauguccuaggauguugaccu

SEQ ID NO: 3386 - RNA, 23 nt, Artificial Sequence
  source: /note="Description of Artificial Sequence: Synthetic oligonucleotide"
ugauccaaaaauguccuaggaug

SEQ ID NO: 3387 - RNA, 23 nt, Artificial Sequence
  source: /note="Description of Artificial Sequence: Synthetic oligonucleotide"
agugcuuuugugauccaaaaaug

SEQ ID NO: 3388 - RNA, 23 nt, Artificial Sequence
  source: /note="Description of Artificial Sequence: Synthetic oligonucleotide"
ucaucgauggaagaagugcuuuu

SEQ ID NO: 3389 - RNA, 23 nt, Artificial Sequence
  source: /note="Description of Artificial Sequence: Synthetic oligonucleotide"
aucaucgauggaagaagugcuuu

SEQ ID NO: 3390 - RNA, 23 nt, Artificial Sequence
  source: /note="Description of Artificial Sequence: Synthetic oligonucleotide"
uuggccaugauuucucuccauca

SEQ ID NO: 3391 - RNA, 23 nt, Artificial Sequence
  source: /note="Description of Artificial Sequence: Synthetic oligonucleotide"
auguggccaugauuucucuccau

SEQ ID NO: 3392 - RNA, 23 nt, Artificial Sequence
  source: /note="Description of Artificial Sequence: Synthetic oligonucleotide"
acgauguggccaugauuucucuc

SEQ ID NO: 3393 - RNA, 23 nt, Artificial Sequence
  source: /note="Description of Artificial Sequence: Synthetic oligonucleotide"
uacgauguggccaugauuucucu

SEQ ID NO: 3394 - RNA, 23 nt, Artificial Sequence
  source: /note="Description of Artificial Sequence: Synthetic oligonucleotide"
ugacgauguggccaugauuucuc

SEQ ID NO: 3395 - RNA, 23 nt, Artificial Sequence
  source: /note="Description of Artificial Sequence: Synthetic oligonucleotide"
uugacgauguggccaugauuucu

SEQ ID NO: 3396 - RNA, 23 nt, Artificial Sequence
  source: /note="Description of Artificial Sequence: Synthetic oligonucleotide"
uugaagccacugugacgaugugg

SEQ ID NO: 3397 - RNA, 23 nt, Artificial Sequence
  source: /note="Description of Artificial Sequence: Synthetic oligonucleotide"
acugaagccacugugacgaugug

SEQ ID NO: 3398 - RNA, 23 nt, Artificial Sequence
  source: /note="Description of Artificial Sequence: Synthetic oligonucleotide"
uacugaagccacugugacgaugu

SEQ ID NO: 3399 - RNA, 23 nt, Artificial Sequence
  source: /note="Description of Artificial Sequence: Synthetic oligonucleotide"
acacugaagccacugugacgaug

SEQ ID NO: 3400 - RNA, 23 nt, Artificial Sequence
  source: /note="Description of Artificial Sequence: Synthetic oligonucleotide"
uaaggaaucccuucguggccgca

SEQ ID NO: 3401 - RNA, 23 nt, Artificial Sequence
  source: /note="Description of Artificial Sequence: Synthetic oligonucleotide"
uuaaggaaucccuucguggccgc

SEQ ID NO: 3402 - RNA, 23 nt, Artificial Sequence
  source: /note="Description of Artificial Sequence: Synthetic oligonucleotide"
agguaaggaaucccuucguggcc

SEQ ID NO: 3403 - RNA, 23 nt, Artificial Sequence
  source: /note="Description of Artificial Sequence: Synthetic oligonucleotide"
uagguaaggaaucccuucguggc

SEQ ID NO: 3404 - RNA, 23 nt, Artificial Sequence
  source: /note="Description of Artificial Sequence: Synthetic oligonucleotide"
ugagguaaggaaucccuucgugg

SEQ ID NO: 3405 - RNA, 23 nt, Artificial Sequence
  source: /note="Description of Artificial Sequence: Synthetic oligonucleotide"
uaugagguaaggaaucccuucgu

SEQ ID NO: 3406 - RNA, 23 nt, Artificial Sequence
  source: /note="Description of Artificial Sequence: Synthetic oligonucleotide"
ugaugagguaaggaaucccuucg

SEQ ID NO: 3407 - RNA, 23 nt, Artificial Sequence
  source: /note="Description of Artificial Sequence: Synthetic oligonucleotide"
uugcuggaacaauaugggaugag

SEQ ID NO: 3408 - RNA, 23 nt, Artificial Sequence
  source: /note="Description of Artificial Sequence: Synthetic oligonucleotide"
uagcggcaaauuugcuggaacaa

SEQ ID NO: 3409 - RNA, 23 nt, Artificial Sequence
  source: /note="Description of Artificial Sequence: Synthetic oligonucleotide"
ugaaagccaacagcggcaaauuu

SEQ ID NO: 3410 - RNA, 23 nt, Artificial Sequence
  source: /note="Description of Artificial Sequence: Synthetic oligonucleotide"
uugaaagccaacagcggcaaauu

SEQ ID NO: 3411 - RNA, 23 nt, Artificial Sequence
  source: /note="Description of Artificial Sequence: Synthetic oligonucleotide"
ugugaaagccaacagcggcaaau

SEQ ID NO: 3412 - RNA, 23 nt, Artificial Sequence
  source: /note="Description of Artificial Sequence: Synthetic oligonucleotide"
augucagaccucugugaaagcca

SEQ ID NO: 3413 - RNA, 23 nt, Artificial Sequence
  source: /note="Description of Artificial Sequence: Synthetic oligonucleotide"
uucugaugucagaccucugugaa

SEQ ID NO: 3414 - RNA, 23 nt, Artificial Sequence
  source: /note="Description of Artificial Sequence: Synthetic oligonucleotide"
ugaaguucugaugucagaccucu

SEQ ID NO: 3415 - RNA, 23 nt, Artificial Sequence
  source: /note="Description of Artificial Sequence: Synthetic oligonucleotide"
uauaccaguuuuucccaaggccu

SEQ ID NO: 3416 - RNA, 23 nt, Artificial Sequence
  source: /note="Description of Artificial Sequence: Synthetic oligonucleotide"
acaugagguuuugauaccaguuu

SEQ ID NO: 3417 - RNA, 23 nt, Artificial Sequence
  source: /note="Description of Artificial Sequence: Synthetic oligonucleotide"
uacaugagguuuugauaccaguu

SEQ ID NO: 3418 - RNA, 23 nt, Artificial Sequence
  source: /note="Description of Artificial Sequence: Synthetic oligonucleotide"
ugugaacccaguauucacaaaaa

SEQ ID NO: 3419 - RNA, 23 nt, Artificial Sequence
  source: /note="Description of Artificial Sequence: Synthetic oligonucleotide"
uggugaacccaguauucacaaaa

SEQ ID NO: 3420 - RNA, 23 nt, Artificial Sequence
  source: /note="Description of Artificial Sequence: Synthetic oligonucleotide"
uuggugaacccaguauucacaaa

SEQ ID NO: 3421 - RNA, 23 nt, Artificial Sequence
  source: /note="Description of Artificial Sequence: Synthetic oligonucleotide"
auuuuuggugaacccaguauuca

SEQ ID NO: 3422 - RNA, 23 nt, Artificial Sequence
  source: /note="Description of Artificial Sequence: Synthetic oligonucleotide"
uauuuuuggugaacccaguauuc

SEQ ID NO: 3423 - RNA, 23 nt, Artificial Sequence
  source: /note="Description of Artificial Sequence: Synthetic oligonucleotide"
ugccauaaucuugugcuuggauu

SEQ ID NO: 3424 - RNA, 23 nt, Artificial Sequence
  source: /note="Description of Artificial Sequence: Synthetic oligonucleotide"
uacaggccauaaucuugugcuug

SEQ ID NO: 3425 - RNA, 23 nt, Artificial Sequence
  source: /note="Description of Artificial Sequence: Synthetic oligonucleotide"
auacaggccauaaucuugugcuu

SEQ ID NO: 3426 - RNA, 23 nt, Artificial Sequence
  source: /note="Description of Artificial Sequence: Synthetic oligonucleotide"
aauacaggccauaaucuugugcu

SEQ ID NO: 3427 - RNA, 23 nt, Artificial Sequence
  source: /note="Description of Artificial Sequence: Synthetic oligonucleotide"
ucaauacaggccauaaucuugug

SEQ ID NO: 3428 - RNA, 23 nt, Artificial Sequence
  source: /note="Description of Artificial Sequence: Synthetic oligonucleotide"
uuccaauacaggccauaaucuug

SEQ ID NO: 3429 - RNA, 23 nt, Artificial Sequence
  source: /note="Description of Artificial Sequence: Synthetic oligonucleotide"
uucuccaauacaggccauaaucu

SEQ ID NO: 3430 - RNA, 23 nt, Artificial Sequence
  source: /note="Description of Artificial Sequence: Synthetic oligonucleotide"
ugucuccaauacaggccauaauc

SEQ ID NO: 3431 - RNA, 23 nt, Artificial Sequence
  source: /note="Description of Artificial Sequence: Synthetic oligonucleotide"
aucugucuccaauacaggccaua

SEQ ID NO: 3432 - RNA, 23 nt, Artificial Sequence
  source: /note="Description of Artificial Sequence: Synthetic oligonucleotide"
uaucugucuccaauacaggccau

SEQ ID NO: 3433 - RNA, 23 nt, Artificial Sequence
  source: /note="Description of Artificial Sequence: Synthetic oligonucleotide"
uacgacuucaucugucuccaaua

SEQ ID NO: 3434 - RNA, 23 nt, Artificial Sequence
  source: /note="Description of Artificial Sequence: Synthetic oligonucleotide"
acuucuuacgacuucaucugucu

SEQ ID NO: 3435 - RNA, 23 nt, Artificial Sequence
  source: /note="Description of Artificial Sequence: Synthetic oligonucleotide"
uacuucuuacgacuucaucuguc

SEQ ID NO: 3436 - RNA, 23 nt, Artificial Sequence
  source: /note="Description of Artificial Sequence: Synthetic oligonucleotide"
agacuucuuacgacuucaucugu

SEQ ID NO: 3437 - RNA, 23 nt, Artificial Sequence
  source: /note="Description of Artificial Sequence: Synthetic oligonucleotide"
uagacuucuuacgacuucaucug

SEQ ID NO: 3438 - RNA, 23 nt, Artificial Sequence
  source: /note="Description of Artificial Sequence: Synthetic oligonucleotide"
uaucagacuucuuacgacuucau

SEQ ID NO: 3439 - RNA, 23 nt, Artificial Sequence
  source: /note="Description of Artificial Sequence: Synthetic oligonucleotide"
ucuaucagacuucuuacgacuuc

SEQ ID NO: 3440 - RNA, 23 nt, Artificial Sequence
  source: /note="Description of Artificial Sequence: Synthetic oligonucleotide"
uuccaucuaucagacuucuuacg

SEQ ID NO: 3441 - RNA, 23 nt, Artificial Sequence
  source: /note="Description of Artificial Sequence: Synthetic oligonucleotide"
auuccaucuaucagacuucuuac

SEQ ID NO: 3442 - RNA, 23 nt, Artificial Sequence
  source: /note="Description of Artificial Sequence: Synthetic oligonucleotide"
uuauuccaucuaucagacuucuu

SEQ ID NO: 3443 - RNA, 23 nt, Artificial Sequence
  source: /note="Description of Artificial Sequence: Synthetic oligonucleotide"
aguauuccaucuaucagacuucu

SEQ ID NO: 3444 - RNA, 23 nt, Artificial Sequence
  source: /note="Description of Artificial Sequence: Synthetic oligonucleotide"
uucuuauugguaaguauuccauc

SEQ ID NO: 3445 - RNA, 23 nt, Artificial Sequence
  source: /note="Description of Artificial Sequence: Synthetic oligonucleotide"
uacgauggaacaaaaaucauuuu

SEQ ID NO: 3446 - RNA, 23 nt, Artificial Sequence
  source: /note="Description of Artificial Sequence: Synthetic oligonucleotide"
auacgauggaacaaaaaucauuu

SEQ ID NO: 3447 - RNA, 23 nt, Artificial Sequence
  source: /note="Description of Artificial Sequence: Synthetic oligonucleotide"
uauauacgauggaacaaaaauca

SEQ ID NO: 3448 - RNA, 23 nt, Artificial Sequence
  source: /note="Description of Artificial Sequence: Synthetic oligonucleotide"
uauugauauacgauggaacaaaa

SEQ ID NO: 3449 - RNA, 23 nt, Artificial Sequence
  source: /note="Description of Artificial Sequence: Synthetic oligonucleotide"
uauauugauauacgauggaacaa

SEQ ID NO: 3450 - RNA, 23 nt, Artificial Sequence
  source: /note="Description of Artificial Sequence: Synthetic oligonucleotide"
agauauugauauacgauggaaca

SEQ ID NO: 3451 - RNA, 23 nt, Artificial Sequence
  source: /note="Description of Artificial Sequence: Synthetic oligonucleotide"
aagauauugauauacgauggaac

SEQ ID NO: 3452 - RNA, 23 nt, Artificial Sequence
  source: /note="Description of Artificial Sequence: Synthetic oligonucleotide"
aaagauauugauauacgauggaa

SEQ ID NO: 3453 - RNA, 23 nt, Artificial Sequence
  source: /note="Description of Artificial Sequence: Synthetic oligonucleotide"
uguucaggaagaaacuucuguag

SEQ ID NO: 3454 - RNA, 23 nt, Artificial Sequence
  source: /note="Description of Artificial Sequence: Synthetic oligonucleotide"
ugcguucaggaagaaacuucugu

SEQ ID NO: 3455 - RNA, 23 nt, Artificial Sequence
  source: /note="Description of Artificial Sequence: Synthetic oligonucleotide"
ugcgcguucaggaagaaacuucu

SEQ ID NO: 3456 - RNA, 23 nt, Artificial Sequence
  source: /note="Description of Artificial Sequence: Synthetic oligonucleotide"
uaggcgcguucaggaagaaacuu

SEQ ID NO: 3457 - RNA, 23 nt, Artificial Sequence
  source: /note="Description of Artificial Sequence: Synthetic oligonucleotide"
ucugaggcgcguucaggaagaaa

SEQ ID NO: 3458 - RNA, 23 nt, Artificial Sequence
  source: /note="Description of Artificial Sequence: Synthetic oligonucleotide"
uacgauuuaaaaucgcugaggcg

SEQ ID NO: 3459 - RNA, 23 nt, Artificial Sequence
  source: /note="Description of Artificial Sequence: Synthetic oligonucleotide"
auacgauuuaaaaucgcugaggc

SEQ ID NO: 3460 - RNA, 23 nt, Artificial Sequence
  source: /note="Description of Artificial Sequence: Synthetic oligonucleotide"
uauacgauuuaaaaucgcugagg

SEQ ID NO: 3461 - RNA, 23 nt, Artificial Sequence
  source: /note="Description of Artificial Sequence: Synthetic oligonucleotide"
ucauacgauuuaaaaucgcugag

SEQ ID NO: 3462 - RNA, 23 nt, Artificial Sequence
  source: /note="Description of Artificial Sequence: Synthetic oligonucleotide"
ugcauacgauuuaaaaucgcuga

SEQ ID NO: 3463 - RNA, 23 nt, Artificial Sequence
  source: /note="Description of Artificial Sequence: Synthetic oligonucleotide"
uugcauacgauuuaaaaucgcug

SEQ ID NO: 3464 - RNA, 23 nt, Artificial Sequence
  source: /note="Description of Artificial Sequence: Synthetic oligonucleotide"
ucugcauacgauuuaaaaucgcu

SEQ ID NO: 3465 - RNA, 23 nt, Artificial Sequence
  source: /note="Description of Artificial Sequence: Synthetic oligonucleotide"
uucugcauacgauuuaaaaucgc

SEQ ID NO: 3466 - RNA, 23 nt, Artificial Sequence
  source: /note="Description of Artificial Sequence: Synthetic oligonucleotide"
auucugcauacgauuuaaaaucg

SEQ ID NO: 3467 - RNA, 23 nt, Artificial Sequence
  source: /note="Description of Artificial Sequence: Synthetic oligonucleotide"
uauucugcauacgauuuaaaauc

SEQ ID NO: 3468 - RNA, 23 nt, Artificial Sequence
  source: /note="Description of Artificial Sequence: Synthetic oligonucleotide"
ugaauauucugcauacgauuuaa

SEQ ID NO: 3469 - RNA, 23 nt, Artificial Sequence
  source: /note="Description of Artificial Sequence: Synthetic oligonucleotide"
auugaauauucugcauacgauuu

SEQ ID NO: 3470 - RNA, 23 nt, Artificial Sequence
  source: /note="Description of Artificial Sequence: Synthetic oligonucleotide"
accacugcuucaaauugaauauu

SEQ ID NO: 3471 - RNA, 23 nt, Artificial Sequence
  source: /note="Description of Artificial Sequence: Synthetic oligonucleotide"
uuggcuggagcuuauuuauucau

SEQ ID NO: 3472 - RNA, 23 nt, Artificial Sequence
  source: /note="Description of Artificial Sequence: Synthetic oligonucleotide"
ucuggcuggagcuuauuuauuca

SEQ ID NO: 3473 - RNA, 23 nt, Artificial Sequence
  source: /note="Description of Artificial Sequence: Synthetic oligonucleotide"
aucaugcauacaucucuggcugg

SEQ ID NO: 3474 - RNA, 23 nt, Artificial Sequence
  source: /note="Description of Artificial Sequence: Synthetic oligonucleotide"
uaucaugcauacaucucuggcug

SEQ ID NO: 3475 - RNA, 23 nt, Artificial Sequence
  source: /note="Description of Artificial Sequence: Synthetic oligonucleotide"
uugauucgaaacuauucauauca

SEQ ID NO: 3476 - RNA, 23 nt, Artificial Sequence
  source: /note="Description of Artificial Sequence: Synthetic oligonucleotide"
auugauucgaaacuauucauauc

SEQ ID NO: 3477 - RNA, 23 nt, Artificial Sequence
  source: /note="Description of Artificial Sequence: Synthetic oligonucleotide"
uagcauugauucgaaacuauuca

SEQ ID NO: 3478 - RNA, 23 nt, Artificial Sequence
  source: /note="Description of Artificial Sequence: Synthetic oligonucleotide"
uuuaauauuaucaggacugaaaa

SEQ ID NO: 3479 - RNA, 23 nt, Artificial Sequence
  source: /note="Description of Artificial Sequence: Synthetic oligonucleotide"
uagugccaaaccaauguuuuuaa

SEQ ID NO: 3480 - RNA, 23 nt, Artificial Sequence
  source: /note="Description of Artificial Sequence: Synthetic oligonucleotide"
uuagugccaaaccaauguuuuua

SEQ ID NO: 3481 - RNA, 23 nt, Artificial Sequence
  source: /note="Description of Artificial Sequence: Synthetic oligonucleotide"
aauuaaucuuguucguuugacug

SEQ ID NO: 3482 - RNA, 23 nt, Artificial Sequence
  source: /note="Description of Artificial Sequence: Synthetic oligonucleotide"
uguaauuaaucuuguucguuuga

SEQ ID NO: 3483 - RNA, 23 nt, Artificial Sequence
  source: /note="Description of Artificial Sequence: Synthetic oligonucleotide"
agguaauuaaucuuguucguuug

SEQ ID NO: 3484 - RNA, 23 nt, Artificial Sequence
  source: /note="Description of Artificial Sequence: Synthetic oligonucleotide"
uagguaauuaaucuuguucguuu

SEQ ID NO: 3485 - RNA, 23 nt, Artificial Sequence
  source: /note="Description of Artificial Sequence: Synthetic oligonucleotide"
acagguaauuaaucuuguucguu

SEQ ID NO: 3486 - RNA, 23 nt, Artificial Sequence
  source: /note="Description of Artificial Sequence: Synthetic oligonucleotide"
acuacguaaauauucuugagaaa

SEQ ID NO: 3487 - RNA, 23 nt, Artificial Sequence
  source: /note="Description of Artificial Sequence: Synthetic oligonucleotide"
aaacuacguaaauauucuugaga

SEQ ID NO: 3488 - RNA, 23 nt, Artificial Sequence
  source: /note="Description of Artificial Sequence: Synthetic oligonucleotide"
aaaacuacguaaauauucuugag

SEQ ID NO: 3489 - RNA, 23 nt, Artificial Sequence
  source: /note="Description of Artificial Sequence: Synthetic oligonucleotide"
aggaaaaacagaccuaugaaaaa

SEQ ID NO: 3490 - RNA, 23 nt, Artificial Sequence
  source: /note="Description of Artificial Sequence: Synthetic oligonucleotide"
uaaguuuuuaagaggcaugaaag

SEQ ID NO: 3491 - RNA, 23 nt, Artificial Sequence
  source: /note="Description of Artificial Sequence: Synthetic oligonucleotide"
uauguaagcacagaaguuuuuaa

SEQ ID NO: 3492 - RNA, 23 nt, Artificial Sequence
  source: /note="Description of Artificial Sequence: Synthetic oligonucleotide"
uuauguaagcacagaaguuuuua

SEQ ID NO: 3493 - RNA, 23 nt, Artificial Sequence
  source: /note="Description of Artificial Sequence: Synthetic oligonucleotide"
uuuauguaagcacagaaguuuuu

SEQ ID NO: 3494 - RNA, 23 nt, Artificial Sequence
  source: /note="Description of Artificial Sequence: Synthetic oligonucleotide"
uuccaccuuuaaauggaaaaaua

SEQ ID NO: 3495 - RNA, 23 nt, Artificial Sequence
  source: /note="Description of Artificial Sequence: Synthetic oligonucleotide"
uauuuacuuuuagggagguagcu

SEQ ID NO: 3496 - RNA, 23 nt, Artificial Sequence
  source: /note="Description of Artificial Sequence: Synthetic oligonucleotide"
uuauuuacuuuuagggagguagc

SEQ ID NO: 3497 - RNA, 23 nt, Artificial Sequence
  source: /note="Description of Artificial Sequence: Synthetic oligonucleotide"
uguaaauaaguucucuuuguauu

SEQ ID NO: 3498 - RNA, 23 nt, Artificial Sequence
  source: /note="Description of Artificial Sequence: Synthetic oligonucleotide"
ucuucccuguguaaauaaguucu

SEQ ID NO: 3499 - RNA, 23 nt, Artificial Sequence
  source: /note="Description of Artificial Sequence: Synthetic oligonucleotide"
ucuuaaaccuucccuguguaaau

SEQ ID NO: 3500 - RNA, 23 nt, Artificial Sequence
  source: /note="Description of Artificial Sequence: Synthetic oligonucleotide"
uucuuaaaccuucccuguguaaa

SEQ ID NO: 3501 - RNA, 23 nt, Artificial Sequence
  source: /note="Description of Artificial Sequence: Synthetic oligonucleotide"
agucuuaaaccuucccuguguaa

SEQ ID NO: 3502 - RNA, 23 nt, Artificial Sequence
  source: /note="Description of Artificial Sequence: Synthetic oligonucleotide"
uacuugaacagucuuaaaccuuc

SEQ ID NO: 3503 - RNA, 23 nt, Artificial Sequence
  source: /note="Description of Artificial Sequence: Synthetic oligonucleotide"
ugcuacuugaacagucuuaaacc

SEQ ID NO: 3504 - RNA, 23 nt, Artificial Sequence
  source: /note="Description of Artificial Sequence: Synthetic oligonucleotide"
aaugcuacuugaacagucuuaaa

SEQ ID NO: 3505 - RNA, 23 nt, Artificial Sequence
  source: /note="Description of Artificial Sequence: Synthetic oligonucleotide"
ugaaugcuacuugaacagucuua

SEQ ID NO: 3506 - RNA, 23 nt, Artificial Sequence
  source: /note="Description of Artificial Sequence: Synthetic oligonucleotide"
auuggaaugcuacuugaacaguc

SEQ ID NO: 3507 - RNA, 23 nt, Artificial Sequence
  source: /note="Description of Artificial Sequence: Synthetic oligonucleotide"
agauuggaaugcuacuugaacag

SEQ ID NO: 3508 - RNA, 23 nt, Artificial Sequence
  source: /note="Description of Artificial Sequence: Synthetic oligonucleotide"
uagauuggaaugcuacuugaaca

SEQ ID NO: 3509 - RNA, 23 nt, Artificial Sequence
  source: /note="Description of Artificial Sequence: Synthetic oligonucleotide"
uggcuacagauuggaaugcuacu

SEQ ID NO: 3510 - RNA, 23 nt, Artificial Sequence
  source: /note="Description of Artificial Sequence: Synthetic oligonucleotide"
auggcuacagauuggaaugcuac

SEQ ID NO: 3511 - RNA, 23 nt, Artificial Sequence
  source: /note="Description of Artificial Sequence: Synthetic oligonucleotide"
uauggcuacagauuggaaugcua

SEQ ID NO: 3512 - RNA, 23 nt, Artificial Sequence
  source: /note="Description of Artificial Sequence: Synthetic oligonucleotide"
uuugauauucuguggcauggcua

SEQ ID NO: 3513 - RNA, 23 nt, Artificial Sequence
  source: /note="Description of Artificial Sequence: Synthetic oligonucleotide"
uguugauauucuguggcauggcu

SEQ ID NO: 3514 - RNA, 23 nt, Artificial Sequence
  source: /note="Description of Artificial Sequence: Synthetic oligonucleotide"
uugcacucauucuguguucuugu

SEQ ID NO: 3515 - RNA, 23 nt, Artificial Sequence
  source: /note="Description of Artificial Sequence: Synthetic oligonucleotide"
uauaaagcugccugcugaaacuu

SEQ ID NO: 3516 - RNA, 23 nt, Artificial Sequence
  source: /note="Description of Artificial Sequence: Synthetic oligonucleotide"
agauaaagcugccugcugaaacu

SEQ ID NO: 3517 - RNA, 23 nt, Artificial Sequence
  source: /note="Description of Artificial Sequence: Synthetic oligonucleotide"
uccagguugagauaaagcugccu

SEQ ID NO: 3518 - RNA, 23 nt, Artificial Sequence
  source: /note="Description of Artificial Sequence: Synthetic oligonucleotide"
aaaauauguccagguugagauaa

SEQ ID NO: 3519 - RNA, 23 nt, Artificial Sequence
  source: /note="Description of Artificial Sequence: Synthetic oligonucleotide"
ugcuagggaaaucuuucaaaugc

SEQ ID NO: 3520 - RNA, 23 nt, Artificial Sequence
  source: /note="Description of Artificial Sequence: Synthetic oligonucleotide"
uaggcuagggaaaucuuucaaau

SEQ ID NO: 3521 - RNA, 23 nt, Artificial Sequence
  source: /note="Description of Artificial Sequence: Synthetic oligonucleotide"
agaggcuagggaaaucuuucaaa

SEQ ID NO: 3522 - RNA, 23 nt, Artificial Sequence
  source: /note="Description of Artificial Sequence: Synthetic oligonucleotide"
aagaggcuagggaaaucuuucaa

SEQ ID NO: 3523 - RNA, 23 nt, Artificial Sequence
  source: /note="Description of Artificial Sequence: Synthetic oligonucleotide"
uugcaccguuuugggcuaaugaa

SEQ ID NO: 3524 - RNA, 23 nt, Artificial Sequence
  source: /note="Description of Artificial Sequence: Synthetic oligonucleotide"
uuugcaccguuuugggcuaauga

SEQ ID NO: 3525 - RNA, 23 nt, Artificial Sequence
  source: /note="Description of Artificial Sequence: Synthetic oligonucleotide"
aguugcaccguuuugggcuaaug

SEQ ID NO: 3526 - RNA, 23 nt, Artificial Sequence
  source: /note="Description of Artificial Sequence: Synthetic oligonucleotide"
uaguugcaccguuuugggcuaau

SEQ ID NO: 3527 - RNA, 23 nt, Artificial Sequence
  source: /note="Description of Artificial Sequence: Synthetic oligonucleotide"
agaguugcaccguuuugggcuaa

SEQ ID NO: 3528 - RNA, 23 nt, Artificial Sequence
  source: /note="Description of Artificial Sequence: Synthetic oligonucleotide"
uagaguugcaccguuuugggcua

SEQ ID NO: 3529 - RNA, 23 nt, Artificial Sequence
  source: /note="Description of Artificial Sequence: Synthetic oligonucleotide"
aauagaguugcaccguuuugggc

SEQ ID NO: 3530 - RNA, 23 nt, Artificial Sequence
  source: /note="Description of Artificial Sequence: Synthetic oligonucleotide"
agaauagaguugcaccguuuugg

SEQ ID NO: 3531 - RNA, 23 nt, Artificial Sequence
  source: /note="Description of Artificial Sequence: Synthetic oligonucleotide"
uagaauagaguugcaccguuuug

SEQ ID NO: 3532 - RNA, 23 nt, Artificial Sequence
  source: /note="Description of Artificial Sequence: Synthetic oligonucleotide"
ucagaauagaguugcaccguuuu

SEQ ID NO: 3533 - RNA, 23 nt, Artificial Sequence
  source: /note="Description of Artificial Sequence: Synthetic oligonucleotide"
aguccagaauagaguugcaccgu

SEQ ID NO: 3534 - RNA, 23 nt, Artificial Sequence
  source: /note="Description of Artificial Sequence: Synthetic oligonucleotide"
aaaguccagaauagaguugcacc

SEQ ID NO: 3535 - RNA, 23 nt, Artificial Sequence
  source: /note="Description of Artificial Sequence: Synthetic oligonucleotide"
auaaaguccagaauagaguugca

SEQ ID NO: 3536 - RNA, 23 nt, Artificial Sequence
  source: /note="Description of Artificial Sequence: Synthetic oligonucleotide"
aauaaaguccagaauagaguugc

SEQ ID NO: 3537 - RNA, 23 nt, Artificial Sequence
  source: /note="Description of Artificial Sequence: Synthetic oligonucleotide"
ucaaguaauaaaguccagaauag

SEQ ID NO: 3538 - RNA, 23 nt, Artificial Sequence
  source: /note="Description of Artificial Sequence: Synthetic oligonucleotide"
uguggacuucagaguuauacaga

SEQ ID NO: 3539 - RNA, 23 nt, Artificial Sequence
  source: /note="Description of Artificial Sequence: Synthetic oligonucleotide"
ugguggacuucagaguuauacag

SEQ ID NO: 3540 - RNA, 23 nt, Artificial Sequence
  source: /note="Description of Artificial Sequence: Synthetic oligonucleotide"
uguccacuuuugguggacuucag

SEQ ID NO: 3541 - RNA, 23 nt, Artificial Sequence
  source: /note="Description of Artificial Sequence: Synthetic oligonucleotide"
uaggguccacuuuugguggacuu

SEQ ID NO: 3542 - RNA, 23 nt, Artificial Sequence
  source: /note="Description of Artificial Sequence: Synthetic oligonucleotide"
auagaggguccacuuuuggugga

SEQ ID NO: 3543 - RNA, 23 nt, Artificial Sequence
  source: /note="Description of Artificial Sequence: Synthetic oligonucleotide"
uauagaggguccacuuuuggugg

SEQ ID NO: 3544 - RNA, 23 nt, Artificial Sequence
  source: /note="Description of Artificial Sequence: Synthetic oligonucleotide"
auauagaggguccacuuuuggug

SEQ ID NO: 3545 - RNA, 23 nt, Artificial Sequence
  source: /note="Description of Artificial Sequence: Synthetic oligonucleotide"
aaauauagaggguccacuuuugg

SEQ ID NO: 3546 - RNA, 23 nt, Artificial Sequence
  source: /note="Description of Artificial Sequence: Synthetic oligonucleotide"
uaaauauagaggguccacuuuug

SEQ ID NO: 3547 - RNA, 23 nt, Artificial Sequence
  source: /note="Description of Artificial Sequence: Synthetic oligonucleotide"
ugaaauauagaggguccacuuuu

SEQ ID NO: 3548 - RNA, 23 nt, Artificial Sequence
  source: /note="Description of Artificial Sequence: Synthetic oligonucleotide"
uggucaccuuucauaauguaucu

SEQ ID NO: 3549 - RNA, 23 nt, Artificial Sequence
  source: /note="Description of Artificial Sequence: Synthetic oligonucleotide"
ucggucaccuuucauaauguauc

SEQ ID NO: 3550 - RNA, 23 nt, Artificial Sequence
  source: /note="Description of Artificial Sequence: Synthetic oligonucleotide"
uucggucaccuuucauaauguau

SEQ ID NO: 3551 - RNA, 23 nt, Artificial Sequence
  source: /note="Description of Artificial Sequence: Synthetic oligonucleotide"
agucggucaccuuucauaaugua

SEQ ID NO: 3552 - RNA, 23 nt, Artificial Sequence
  source: /note="Description of Artificial Sequence: Synthetic oligonucleotide"
uagucggucaccuuucauaaugu

SEQ ID NO: 3553 - RNA, 23 nt, Artificial Sequence
  source: /note="Description of Artificial Sequence: Synthetic oligonucleotide"
uuaaaauagagucggucaccuuu

SEQ ID NO: 3554 - RNA, 23 nt, Artificial Sequence
  source: /note="Description of Artificial Sequence: Synthetic oligonucleotide"
uagaacuuaaaauucugagauuu

SEQ ID NO: 3555 - RNA, 23 nt, Artificial Sequence
  source: /note="Description of Artificial Sequence: Synthetic oligonucleotide"
uggaccaaggauauaugaaagca

SEQ ID NO: 3556 - RNA, 23 nt, Artificial Sequence
  source: /note="Description of Artificial Sequence: Synthetic oligonucleotide"
ugggaccaaggauauaugaaagc

SEQ ID NO: 3557 - RNA, 23 nt, Artificial Sequence
  source: /note="Description of Artificial Sequence: Synthetic oligonucleotide"
uugggaccaaggauauaugaaag

SEQ ID NO: 3558 - RNA, 23 nt, Artificial Sequence
  source: /note="Description of Artificial Sequence: Synthetic oligonucleotide"
uugucuaaacaucucugggacca

SEQ ID NO: 3559 - RNA, 23 nt, Artificial Sequence
  source: /note="Description of Artificial Sequence: Synthetic oligonucleotide"
aaaauugucuaaacaucucuggg

SEQ ID NO: 3560 - RNA, 23 nt, Artificial Sequence
  source: /note="Description of Artificial Sequence: Synthetic oligonucleotide"
uaaaauugucuaaacaucucugg

SEQ ID NO: 3561 - RNA, 23 nt, Artificial Sequence
  source: /note="Description of Artificial Sequence: Synthetic oligonucleotide"
ugagccuaaaauugucuaaacau

SEQ ID NO: 3562 - RNA, 23 nt, Artificial Sequence
  source: /note="Description of Artificial Sequence: Synthetic oligonucleotide"
uugagccuaaaauugucuaaaca

SEQ ID NO: 3563 - RNA, 23 nt, Artificial Sequence
  source: /note="Description of Artificial Sequence: Synthetic oligonucleotide"
uuugagccuaaaauugucuaaac

SEQ ID NO: 3564 - RNA, 23 nt, Artificial Sequence
  source: /note="Description of Artificial Sequence: Synthetic oligonucleotide"
uuuugagccuaaaauugucuaaa

SEQ ID NO: 3565 - RNA, 23 nt, Artificial Sequence
  source: /note="Description of Artificial Sequence: Synthetic oligonucleotide"
uuuuugagccuaaaauugucuaa

SEQ ID NO: 3566 - RNA, 23 nt, Artificial Sequence
  source: /note="Description of Artificial Sequence: Synthetic oligonucleotide"
aauuuuugagccuaaaauugucu

SEQ ID NO: 3567 - RNA, 23 nt, Artificial Sequence
  source: /note="Description of Artificial Sequence: Synthetic oligonucleotide"
ucuuuaauuuuugagccuaaaau

SEQ ID NO: 3568 - RNA, 23 nt, Artificial Sequence
  source: /note="Description of Artificial Sequence: Synthetic oligonucleotide"
agcuuuaauuuuugagccuaaaa

SEQ ID NO: 3569 - RNA, 23 nt, Artificial Sequence
  source: /note="Description of Artificial Sequence: Synthetic oligonucleotide"
uagcuuuaauuuuugagccuaaa

SEQ ID NO: 3570 - RNA, 23 nt, Artificial Sequence
  source: /note="Description of Artificial Sequence: Synthetic oligonucleotide"
ucaguacaguuccuuuuccugug

SEQ ID NO: 3571 - RNA, 23 nt, Artificial Sequence
  source: /note="Description of Artificial Sequence: Synthetic oligonucleotide"
agccaguacaguuccuuuuccug

SEQ ID NO: 3572 - RNA, 23 nt, Artificial Sequence
  source: /note="Description of Artificial Sequence: Synthetic oligonucleotide"
auagccaguacaguuccuuuucc

SEQ ID NO: 3573 - RNA, 23 nt, Artificial Sequence
  source: /note="Description of Artificial Sequence: Synthetic oligonucleotide"
uuaauagccaguacaguuccuuu

SEQ ID NO: 3574 - RNA, 23 nt, Artificial Sequence
  source: /note="Description of Artificial Sequence: Synthetic oligonucleotide"
uguaauagccaguacaguuccuu

SEQ ID NO: 3575 - RNA, 23 nt, Artificial Sequence
  source: /note="Description of Artificial Sequence: Synthetic oligonucleotide"
uauguagugggagucggauuauu

SEQ ID NO: 3576 - RNA, 23 nt, Artificial Sequence
  source: /note="Description of Artificial Sequence: Synthetic oligonucleotide"
uuugauguagugggagucggauu

SEQ ID NO: 3577 - RNA, 23 nt, Artificial Sequence
  source: /note="Description of Artificial Sequence: Synthetic oligonucleotide"
uuagucuugauguagugggaguc

SEQ ID NO: 3578 - RNA, 23 nt, Artificial Sequence
  source: /note="Description of Artificial Sequence: Synthetic oligonucleotide"
auuagucuugauguagugggagu

SEQ ID NO: 3579 - RNA, 23 nt, Artificial Sequence
  source: /note="Description of Artificial Sequence: Synthetic oligonucleotide"
uauuagucuugauguagugggag

SEQ ID NO: 3580 - RNA, 23 nt, Artificial Sequence
  source: /note="Description of Artificial Sequence: Synthetic oligonucleotide"
agauuagucuugauguaguggga

SEQ ID NO: 3581 - RNA, 23 nt, Artificial Sequence
  source: /note="Description of Artificial Sequence: Synthetic oligonucleotide"
uaagauuagucuugauguagugg

SEQ ID NO: 3582 - RNA, 23 nt, Artificial Sequence
  source: /note="Description of Artificial Sequence: Synthetic oligonucleotide"
acaagauuagucuugauguagug

SEQ ID NO: 3583 - RNA, 23 nt, Artificial Sequence
  source: /note="Description of Artificial Sequence: Synthetic oligonucleotide"
aacaagauuagucuugauguagu

SEQ ID NO: 3584 - RNA, 23 nt, Artificial Sequence
  source: /note="Description of Artificial Sequence: Synthetic oligonucleotide"
aaacaagauuagucuugauguag

SEQ ID NO: 3585 - RNA, 23 nt, Artificial Sequence
  source: /note="Description of Artificial Sequence: Synthetic oligonucleotide"
ugcaaaagcauucuauaauacau

SEQ ID NO: 3586 - RNA, 23 nt, Artificial Sequence
  source: /note="Description of Artificial Sequence: Synthetic oligonucleotide"
uccaugcaaaagcauucuauaau

SEQ ID NO: 3587 - RNA, 23 nt, Artificial Sequence
  source: /note="Description of Artificial Sequence: Synthetic oligonucleotide"
uaguccaugcaaaagcauucuau

SEQ ID NO: 3588 - RNA, 23 nt, Artificial Sequence
  source: /note="Description of Artificial Sequence: Synthetic oligonucleotide"
auaguccaugcaaaagcauucua

SEQ ID NO: 3589 - RNA, 23 nt, Artificial Sequence
  source: /note="Description of Artificial Sequence: Synthetic oligonucleotide"
aggauaguccaugcaaaagcauu

SEQ ID NO: 3590 - RNA, 23 nt, Artificial Sequence
  source: /note="Description of Artificial Sequence: Synthetic oligonucleotide"
agaggauaguccaugcaaaagca

SEQ ID NO: 3591 - RNA, 23 nt, Artificial Sequence
  source: /note="Description of Artificial Sequence: Synthetic oligonucleotide"
aacaagaggauaguccaugcaaa

SEQ ID NO: 3592 - RNA, 23 nt, Artificial Sequence
  source: /note="Description of Artificial Sequence: Synthetic oligonucleotide"
aaacaagaggauaguccaugcaa

SEQ ID NO: 3593 - RNA, 23 nt, Artificial Sequence
  source: /note="Description of Artificial Sequence: Synthetic oligonucleotide"
uauaacuacaagagguuauuuuu

SEQ ID NO: 3594 - RNA, 23 nt, Artificial Sequence
  source: /note="Description of Artificial Sequence: Synthetic oligonucleotide"
auuuuauaacuacaagagguuau

SEQ ID NO: 3595 - RNA, 21 nt, Artificial Sequence
  source: /note="Description of Artificial Sequence: Synthetic oligonucleotide"
caguaccuccucccuaggacu

SEQ ID NO: 3596 - RNA, 21 nt, Artificial Sequence
  source: /note="Description of Artificial Sequence: Synthetic oligonucleotide"
aguaccuccucccuaggacua

SEQ ID NO: 3597 - RNA, 21 nt, Artificial Sequence
  source: /note="Description of Artificial Sequence: Synthetic oligonucleotide"
guaccuccucccuaggacuaa

SEQ ID NO: 3598 - RNA, 21 nt, Artificial Sequence
  source: /note="Description of Artificial Sequence: Synthetic oligonucleotide"
acuacacaaggacugaaccaa

SEQ ID NO: 3599 - RNA, 21 nt, Artificial Sequence
  source: /note="Description of Artificial Sequence: Synthetic oligonucleotide"
cuacacaaggacugaaccaga

SEQ ID NO: 3600 - RNA, 21 nt, Artificial Sequence
  source: /note="Description of Artificial Sequence: Synthetic oligonucleotide"
acacaaggacugaaccagaaa

SEQ ID NO: 3601 - RNA, 21 nt, Artificial Sequence
  source: /note="Description of Artificial Sequence: Synthetic oligonucleotide"
cagagcaaagccaugaacaua

SEQ ID NO: 3602 - RNA, 21 nt, Artificial Sequence
  source: /note="Description of Artificial Sequence: Synthetic oligonucleotide"
ucauccuagaaauccuucuga

SEQ ID NO: 3603 - RNA, 21 nt, Artificial Sequence
  source: /note="Description of Artificial Sequence: Synthetic oligonucleotide"
uccuucugcuucugaucacca

SEQ ID NO: 3604 - RNA, 21 nt, Artificial Sequence
  source: /note="Description of Artificial Sequence: Synthetic oligonucleotide"
ccaucaucuacuccuacuuga

SEQ ID NO: 3605 - RNA, 21 nt, Artificial Sequence
  source: /note="Description of Artificial Sequence: Synthetic oligonucleotide"
ucuacuccuacuuggagucgu

SEQ ID NO: 3606 - RNA, 21 nt, Artificial Sequence
  source: /note="Description of Artificial Sequence: Synthetic oligonucleotide"
cuacuccuacuuggagucguu

SEQ ID NO: 3607 - RNA, 21 nt, Artificial Sequence
  source: /note="Description of Artificial Sequence: Synthetic oligonucleotide"
uacuccuacuuggagucguua

SEQ ID NO: 3608 - RNA, 21 nt, Artificial Sequence
  source: /note="Description of Artificial Sequence: Synthetic oligonucleotide"
acuccuacuuggagucguuga

SEQ ID NO: 3609 - RNA, 21 nt, Artificial Sequence
  source: /note="Description of Artificial Sequence: Synthetic oligonucleotide"
cuccuacuuggagucguuggu

SEQ ID NO: 3610 - RNA, 21 nt, Artificial Sequence
  source: /note="Description of Artificial Sequence: Synthetic oligonucleotide"
uccuacuuggagucguuggua

SEQ ID NO: 3611 - RNA, 21 nt, Artificial Sequence
  source: /note="Description of Artificial Sequence: Synthetic oligonucleotide"
gucguuggugaaguuuuucau

SEQ ID NO: 3612 - RNA, 21 nt, Artificial Sequence
  source: /note="Description of Artificial Sequence: Synthetic oligonucleotide"
gagauuguucucauuacugga

SEQ ID NO: 3613 - RNA, 21 nt, Artificial Sequence
  source: /note="Description of Artificial Sequence: Synthetic oligonucleotide"
uuguucucauuacuggagcua

SEQ ID NO: 3614 - RNA, 21 nt, Artificial Sequence
  source: /note="Description of Artificial Sequence: Synthetic oligonucleotide"
gcagacuacuuaugaauuuga

SEQ ID NO: 3615 - RNA, 21 nt, Artificial Sequence
  source: /note="Description of Artificial Sequence: Synthetic oligonucleotide"
acuuaugaauuugcaaaacga

SEQ ID NO: 3616 - RNA, 21 nt, Artificial Sequence
  source: /note="Description of Artificial Sequence: Synthetic oligonucleotide"
auuugcaaaacgacagagcau

SEQ ID NO: 3617 - RNA, 21 nt, Artificial Sequence
  source: /note="Description of Artificial Sequence: Synthetic oligonucleotide"
uuugcaaaacgacagagcaua

SEQ ID NO: 3618 - RNA, 21 nt, Artificial Sequence
  source: /note="Description of Artificial Sequence: Synthetic oligonucleotide"
cagagcauauugguucuguga

SEQ ID NO: 3619 - RNA, 21 nt, Artificial Sequence
  source: /note="Description of Artificial Sequence: Synthetic oligonucleotide"
agagcauauugguucugugga

SEQ ID NO: 3620 - RNA, 21 nt, Artificial Sequence
  source: /note="Description of Artificial Sequence: Synthetic oligonucleotide"
gagcauauugguucuguggga

SEQ ID NO: 3621 - RNA, 21 nt, Artificial Sequence
  source: /note="Description of Artificial Sequence: Synthetic oligonucleotide"
cugugggauauuaauaagcga

SEQ ID NO: 3622 - RNA, 21 nt, Artificial Sequence
  source: /note="Description of Artificial Sequence: Synthetic oligonucleotide"
auuaauaagcgcgguguggaa

SEQ ID NO: 3623 - RNA, 21 nt, Artificial Sequence
  source: /note="Description of Artificial Sequence: Synthetic oligonucleotide"
uuaauaagcgcgguguggaga

SEQ ID NO: 3624 - RNA, 21 nt, Artificial Sequence
  source: /note="Description of Artificial Sequence: Synthetic oligonucleotide"
aaacugcagcugagugccgaa

SEQ ID NO: 3625 - RNA, 21 nt, Artificial Sequence
  source: /note="Description of Artificial Sequence: Synthetic oligonucleotide"
aacugcagcugagugccgaaa

SEQ ID NO: 3626 - RNA, 21 nt, Artificial Sequence
  source: /note="Description of Artificial Sequence: Synthetic oligonucleotide"
acugcagcugagugccgaaaa

SEQ ID NO: 3627 - RNA, 21 nt, Artificial Sequence
  source: /note="Description of Artificial Sequence: Synthetic oligonucleotide"
cugcagcugagugccgaaaac

SEQ ID NO: 3628 - RNA, 21 nt, Artificial Sequence
  source: /note="Description of Artificial Sequence: Synthetic oligonucleotide"
ugcagcugagugccgaaaacu

SEQ ID NO: 3629 - RNA, 21 nt, Artificial Sequence
  source: /note="Description of Artificial Sequence: Synthetic oligonucleotide"
gcagcugagugccgaaaacua

SEQ ID NO: 3630 - RNA, 21 nt, Artificial Sequence
  source: /note="Description of Artificial Sequence: Synthetic oligonucleotide"
cagcugagugccgaaaacuaa

SEQ ID NO: 3631 - RNA, 21 nt, Artificial Sequence
  source: /note="Description of Artificial Sequence: Synthetic oligonucleotide"
gcugagugccgaaaacuagga

SEQ ID NO: 3632 - RNA, 21 nt, Artificial Sequence
  source: /note="Description of Artificial Sequence: Synthetic oligonucleotide"
cugagugccgaaaacuaggca

SEQ ID NO: 3633 - RNA, 21 nt, Artificial Sequence
  source: /note="Description of Artificial Sequence: Synthetic oligonucleotide"
ugagugccgaaaacuaggcgu

SEQ ID NO: 3634 - RNA, 21 nt, Artificial Sequence
  source: /note="Description of Artificial Sequence: Synthetic oligonucleotide"
gagugccgaaaacuaggcgua

SEQ ID NO: 3635 - RNA, 21 nt, Artificial Sequence
  source: /note="Description of Artificial Sequence: Synthetic oligonucleotide"
agugccgaaaacuaggcguca

SEQ ID NO: 3636 - RNA, 21 nt, Artificial Sequence
  source: /note="Description of Artificial Sequence: Synthetic oligonucleotide"
gugccgaaaacuaggcgucaa

SEQ ID NO: 3637 - RNA, 21 nt, Artificial Sequence
  source: /note="Description of Artificial Sequence: Synthetic oligonucleotide"
ugccgaaaacuaggcgucacu

SEQ ID NO: 3638 - RNA, 21 nt, Artificial Sequence
  source: /note="Description of Artificial Sequence: Synthetic oligonucleotide"
gccgaaaacuaggcgucacua

SEQ ID NO: 3639 - RNA, 21 nt, Artificial Sequence
  source: /note="Description of Artificial Sequence: Synthetic oligonucleotide"
ccgaaaacuaggcgucacuga

SEQ ID NO: 3640 - RNA, 21 nt, Artificial Sequence
  source: /note="Description of Artificial Sequence: Synthetic oligonucleotide"
cgaaaacuaggcgucacugca

SEQ ID NO: 3641 - RNA, 21 nt, Artificial Sequence
  source: /note="Description of Artificial Sequence: Synthetic oligonucleotide"
aaaacuaggcgucacugcgca

SEQ ID NO: 3642 - RNA, 21 nt, Artificial Sequence
  source: /note="Description of Artificial Sequence: Synthetic oligonucleotide"
aacuaggcgucacugcgcaua

SEQ ID NO: 3643 - RNA, 21 nt, Artificial Sequence
  source: /note="Description of Artificial Sequence: Synthetic oligonucleotide"
acuaggcgucacugcgcauga

SEQ ID NO: 3644 - RNA, 21 nt, Artificial Sequence
  source: /note="Description of Artificial Sequence: Synthetic oligonucleotide"
ggcgucacugcgcaugcguau

SEQ ID NO: 3645 - RNA, 21 nt, Artificial Sequence
  source: /note="Description of Artificial Sequence: Synthetic oligonucleotide"
gcaugcguaugugguagacua

SEQ ID NO: 3646 - RNA, 21 nt, Artificial Sequence
  source: /note="Description of Artificial Sequence: Synthetic oligonucleotide"
caugcguaugugguagacuga

SEQ ID NO: 3647 - RNA, 21 nt, Artificial Sequence
  source: /note="Description of Artificial Sequence: Synthetic oligonucleotide"
aacagagaagagaucuaucga

SEQ ID NO: 3648 - RNA, 21 nt, Artificial Sequence
  source: /note="Description of Artificial Sequence: Synthetic oligonucleotide"
acagagaagagaucuaucgcu

SEQ ID NO: 3649 - RNA, 21 nt, Artificial Sequence
  source: /note="Description of Artificial Sequence: Synthetic oligonucleotide"
cagagaagagaucuaucgcua

SEQ ID NO: 3650 - RNA, 21 nt, Artificial Sequence
  source: /note="Description of Artificial Sequence: Synthetic oligonucleotide"
agagaagagaucuaucgcucu

SEQ ID NO: 3651 - RNA, 21 nt, Artificial Sequence
  source: /note="Description of Artificial Sequence: Synthetic oligonucleotide"
gagaagagaucuaucgcucua

SEQ ID NO: 3652 - RNA, 21 nt, Artificial Sequence
  source: /note="Description of Artificial Sequence: Synthetic oligonucleotide"
gaagagaucuaucgcucucua

SEQ ID NO: 3653 - RNA, 21 nt, Artificial Sequence
  source: /note="Description of Artificial Sequence: Synthetic oligonucleotide"
aagagaucuaucgcucucuaa

SEQ ID NO: 3654 - RNA, 21 nt, Artificial Sequence
  source: /note="Description of Artificial Sequence: Synthetic oligonucleotide"
agagaucuaucgcucucuaaa

SEQ ID NO: 3655 - RNA, 21 nt, Artificial Sequence
  source: /note="Description of Artificial Sequence: Synthetic oligonucleotide"
gaucuaucgcucucuaaauca

SEQ ID NO: 3656 - RNA, 21 nt, Artificial Sequence
  source: /note="Description of Artificial Sequence: Synthetic oligonucleotide"
aucuaucgcucucuaaaucaa

SEQ ID NO: 3657 - RNA, 21 nt, Artificial Sequence
  source: /note="Description of Artificial Sequence: Synthetic oligonucleotide"
cuaucgcucucuaaaucaggu

SEQ ID NO: 3658 - RNA, 21 nt, Artificial Sequence
  source: /note="Description of Artificial Sequence: Synthetic oligonucleotide"
uaucgcucucuaaaucaggua

SEQ ID NO: 3659 - RNA, 21 nt, Artificial Sequence
  source: /note="Description of Artificial Sequence: Synthetic oligonucleotide"
aucgcucucuaaaucagguga

SEQ ID NO: 3660 - RNA, 21 nt, Artificial Sequence
  source: /note="Description of Artificial Sequence: Synthetic oligonucleotide"
gauguaacaaucguggugaau

SEQ ID NO: 3661 - RNA, 21 nt, Artificial Sequence
  source: /note="Description of Artificial Sequence: Synthetic oligonucleotide"
auguaacaaucguggugaaua

SEQ ID NO: 3662 - RNA, 21 nt, Artificial Sequence
  source: /note="Description of Artificial Sequence: Synthetic oligonucleotide"
uguaacaaucguggugaauaa

SEQ ID NO: 3663 - RNA, 21 nt, Artificial Sequence
  source: /note="Description of Artificial Sequence: Synthetic oligonucleotide"
guaacaaucguggugaauaau

SEQ ID NO: 3664 - RNA, 21 nt, Artificial Sequence
  source: /note="Description of Artificial Sequence: Synthetic oligonucleotide"
ggugaauaaugcugggacagu

SEQ ID NO: 3665 - RNA, 21 nt, Artificial Sequence
  source: /note="Description of Artificial Sequence: Synthetic oligonucleotide"
augcugggacaguauauccaa

SEQ ID NO: 3666 - RNA, 21 nt, Artificial Sequence
  source: /note="Description of Artificial Sequence: Synthetic oligonucleotide"
ugcugggacaguauauccaga

SEQ ID NO: 3667 - RNA, 21 nt, Artificial Sequence
  source: /note="Description of Artificial Sequence: Synthetic oligonucleotide"
gcugggacaguauauccagca

SEQ ID NO: 3668 - RNA, 21 nt, Artificial Sequence
  source: /note="Description of Artificial Sequence: Synthetic oligonucleotide"
ugggacaguauauccagccga

SEQ ID NO: 3669 - RNA, 21 nt, Artificial Sequence
  source: /note="Description of Artificial Sequence: Synthetic oligonucleotide"
gggacaguauauccagccgau

SEQ ID NO: 3670 - RNA, 21 nt, Artificial Sequence
  source: /note="Description of Artificial Sequence: Synthetic oligonucleotide"
ggacaguauauccagccgaua

SEQ ID NO: 3671 - RNA, 21 nt, Artificial Sequence
  source: /note="Description of Artificial Sequence: Synthetic oligonucleotide"
caguauauccagccgaucuua

SEQ ID NO: 3672 - RNA, 21 nt, Artificial Sequence
  source: /note="Description of Artificial Sequence: Synthetic oligonucleotide"
gccgaucuucucagcaccaaa

SEQ ID NO: 3673 - RNA, 21 nt, Artificial Sequence
  source: /note="Description of Artificial Sequence: Synthetic oligonucleotide"
ucuucucagcaccaaggauga

SEQ ID NO: 3674 - RNA, 21 nt, Artificial Sequence
  source: /note="Description of Artificial Sequence: Synthetic oligonucleotide"
ccaaggaugaagagauuacca

SEQ ID NO: 3675 - RNA, 21 nt, Artificial Sequence
  source: /note="Description of Artificial Sequence: Synthetic oligonucleotide"
auuaccaagacauuugaggua

SEQ ID NO: 3676 - RNA, 21 nt, Artificial Sequence
  source: /note="Description of Artificial Sequence: Synthetic oligonucleotide"
ccaagacauuugaggucaaca

SEQ ID NO: 3677 - RNA, 21 nt, Artificial Sequence
  source: /note="Description of Artificial Sequence: Synthetic oligonucleotide"
aagacauuugaggucaacaua

SEQ ID NO: 3678 - RNA, 21 nt, Artificial Sequence
  source: /note="Description of Artificial Sequence: Synthetic oligonucleotide"
cauuugaggucaacauccuaa

SEQ ID NO: 3679 - RNA, 21 nt, Artificial Sequence
  source: /note="Description of Artificial Sequence: Synthetic oligonucleotide"
auuugaggucaacauccuaga

SEQ ID NO: 3680 - RNA, 21 nt, Artificial Sequence
  source: /note="Description of Artificial Sequence: Synthetic oligonucleotide"
ggucaacauccuaggacauuu

SEQ ID NO: 3681 - RNA, 21 nt, Artificial Sequence
  source: /note="Description of Artificial Sequence: Synthetic oligonucleotide"
gucaacauccuaggacauuuu

SEQ ID NO: 3682 - RNA, 21 nt, Artificial Sequence
  source: /note="Description of Artificial Sequence: Synthetic oligonucleotide"
uccuaggacauuuuuggauca

SEQ ID NO: 3683 - RNA, 21 nt, Artificial Sequence
  source: /note="Description of Artificial Sequence: Synthetic oligonucleotide"
uuuuuggaucacaaaagcacu

SEQ ID NO: 3684 - RNA, 21 nt, Artificial Sequence
  source: /note="Description of Artificial Sequence: Synthetic oligonucleotide"
aagcacuucuuccaucgauga

SEQ ID NO: 3685 - RNA, 21 nt, Artificial Sequence
  source: /note="Description of Artificial Sequence: Synthetic oligonucleotide"
agcacuucuuccaucgaugau

SEQ ID NO: 3686 - RNA, 21 nt, Artificial Sequence
  source: /note="Description of Artificial Sequence: Synthetic oligonucleotide"
auggagagaaaucauggccaa

SEQ ID NO: 3687 - RNA, 21 nt, Artificial Sequence
  source: /note="Description of Artificial Sequence: Synthetic oligonucleotide"
ggagagaaaucauggccacau

SEQ ID NO: 3688 - RNA, 21 nt, Artificial Sequence
  source: /note="Description of Artificial Sequence: Synthetic oligonucleotide"
gagaaaucauggccacaucgu

SEQ ID NO: 3689 - RNA, 21 nt, Artificial Sequence
  source: /note="Description of Artificial Sequence: Synthetic oligonucleotide"
agaaaucauggccacaucgua

SEQ ID NO: 3690 - RNA, 21 nt, Artificial Sequence
  source: /note="Description of Artificial Sequence: Synthetic oligonucleotide"
gaaaucauggccacaucguca

SEQ ID NO: 3691 - RNA, 21 nt, Artificial Sequence
  source: /note="Description of Artificial Sequence: Synthetic oligonucleotide"
aaaucauggccacaucgucaa

SEQ ID NO: 3692 - RNA, 21 nt, Artificial Sequence
  source: /note="Description of Artificial Sequence: Synthetic oligonucleotide"
acaucgucacaguggcuucaa

SEQ ID NO: 3693 - RNA, 21 nt, Artificial Sequence
  source: /note="Description of Artificial Sequence: Synthetic oligonucleotide"
caucgucacaguggcuucagu

SEQ ID NO: 3694 - RNA, 21 nt, Artificial Sequence
  source: /note="Description of Artificial Sequence: Synthetic oligonucleotide"
aucgucacaguggcuucagua

SEQ ID NO: 3695 - RNA, 21 nt, Artificial Sequence
  source: /note="Description of Artificial Sequence: Synthetic oligonucleotide"
ucgucacaguggcuucagugu

SEQ ID NO: 3696 - RNA, 21 nt, Artificial Sequence
  source: /note="Description of Artificial Sequence: Synthetic oligonucleotide"
cggccacgaagggauuccuua

SEQ ID NO: 3697 - RNA, 21 nt, Artificial Sequence
  source: /note="Description of Artificial Sequence: Synthetic oligonucleotide"
ggccacgaagggauuccuuaa

SEQ ID NO: 3698 - RNA, 21 nt, Artificial Sequence
  source: /note="Description of Artificial Sequence: Synthetic oligonucleotide"
ccacgaagggauuccuuaccu

SEQ ID NO: 3699 - RNA, 21 nt, Artificial Sequence
  source: /note="Description of Artificial Sequence: Synthetic oligonucleotide"
cacgaagggauuccuuaccua

SEQ ID NO: 3700 - RNA, 21 nt, Artificial Sequence
  source: /note="Description of Artificial Sequence: Synthetic oligonucleotide"
acgaagggauuccuuaccuca

SEQ ID NO: 3701 - RNA, 21 nt, Artificial Sequence
  source: /note="Description of Artificial Sequence: Synthetic oligonucleotide"
gaagggauuccuuaccucaua

SEQ ID NO: 3702 - RNA, 21 nt, Artificial Sequence
  source: /note="Description of Artificial Sequence: Synthetic oligonucleotide"
aagggauuccuuaccucauca

SEQ ID NO: 3703 - RNA, 21 nt, Artificial Sequence
  source: /note="Description of Artificial Sequence: Synthetic oligonucleotide"
caucccauauuguuccagcaa

SEQ ID NO: 3704 - RNA, 21 nt, Artificial Sequence
  source: /note="Description of Artificial Sequence: Synthetic oligonucleotide"
guuccagcaaauuugccgcua

SEQ ID NO: 3705 - RNA, 21 nt, Artificial Sequence
  source: /note="Description of Artificial Sequence: Synthetic oligonucleotide"
auuugccgcuguuggcuuuca

SEQ ID NO: 3706 - RNA, 21 nt, Artificial Sequence
  source: /note="Description of Artificial Sequence: Synthetic oligonucleotide"
uuugccgcuguuggcuuucaa

SEQ ID NO: 3707 - RNA, 21 nt, Artificial Sequence
  source: /note="Description of Artificial Sequence: Synthetic oligonucleotide"
uugccgcuguuggcuuucaca

SEQ ID NO: 3708 - RNA, 21 nt, Artificial Sequence
  source: /note="Description of Artificial Sequence: Synthetic oligonucleotide"
gcuuucacagaggucugacau

SEQ ID NO: 3709 - RNA, 21 nt, Artificial Sequence
  source: /note="Description of Artificial Sequence: Synthetic oligonucleotide"
cacagaggucugacaucagaa

SEQ ID NO: 3710 - RNA, 21 nt, Artificial Sequence
  source: /note="Description of Artificial Sequence: Synthetic oligonucleotide"
aggucugacaucagaacuuca

SEQ ID NO: 3711 - RNA, 21 nt, Artificial Sequence
  source: /note="Description of Artificial Sequence: Synthetic oligonucleotide"
gccuugggaaaaacugguaua

SEQ ID NO: 3712 - RNA, 21 nt, Artificial Sequence
  source: /note="Description of Artificial Sequence: Synthetic oligonucleotide"
acugguaucaaaaccucaugu

SEQ ID NO: 3713 - RNA, 21 nt, Artificial Sequence
  source: /note="Description of Artificial Sequence: Synthetic oligonucleotide"
cugguaucaaaaccucaugua

SEQ ID NO: 3714 - RNA, 21 nt, Artificial Sequence
  source: /note="Description of Artificial Sequence: Synthetic oligonucleotide"
uuugugaauacuggguucaca

SEQ ID NO: 3715 - RNA, 21 nt, Artificial Sequence
  source: /note="Description of Artificial Sequence: Synthetic oligonucleotide"
uugugaauacuggguucacca

SEQ ID NO: 3716 - RNA, 21 nt, Artificial Sequence
  source: /note="Description of Artificial Sequence: Synthetic oligonucleotide"
ugugaauacuggguucaccaa

SEQ ID NO: 3717 - RNA, 21 nt, Artificial Sequence
  source: /note="Description of Artificial Sequence: Synthetic oligonucleotide"
aauacuggguucaccaaaaau

SEQ ID NO: 3718 - RNA, 21 nt, Artificial Sequence
  source: /note="Description of Artificial Sequence: Synthetic oligonucleotide"
auacuggguucaccaaaaaua

SEQ ID NO: 3719 - RNA, 21 nt, Artificial Sequence
  source: /note="Description of Artificial Sequence: Synthetic oligonucleotide"
uccaagcacaagauuauggca

SEQ ID NO: 3720 - RNA, 21 nt, Artificial Sequence
  source: /note="Description of Artificial Sequence: Synthetic oligonucleotide"
agcacaagauuauggccugua

SEQ ID NO: 3721 - RNA, 21 nt, Artificial Sequence
  source: /note="Description of Artificial Sequence: Synthetic oligonucleotide"
gcacaagauuauggccuguau

SEQ ID NO: 3722 - RNA, 21 nt, Artificial Sequence
  source: /note="Description of Artificial Sequence: Synthetic oligonucleotide"
cacaagauuauggccuguauu

SEQ ID NO: 3723 - RNA, 21 nt, Artificial Sequence
  source: /note="Description of Artificial Sequence: Synthetic oligonucleotide"
caagauuauggccuguauuga

SEQ ID NO: 3724 - RNA, 21 nt, Artificial Sequence
  source: /note="Description of Artificial Sequence: Synthetic oligonucleotide"
agauuauggccuguauuggaa

SEQ ID NO: 3725 - RNA, 21 nt, Artificial Sequence
  source: /note="Description of Artificial Sequence: Synthetic oligonucleotide"
auuauggccuguauuggagaa

SEQ ID NO: 3726 - RNA, 21 nt, Artificial Sequence
  source: /note="Description of Artificial Sequence: Synthetic oligonucleotide"
uuauggccuguauuggagaca

SEQ ID NO: 3727 - RNA, 21 nt, Artificial Sequence
  source: /note="Description of Artificial Sequence: Synthetic oligonucleotide"
uggccuguauuggagacagau

SEQ ID NO: 3728 - RNA, 21 nt, Artificial Sequence
  source: /note="Description of Artificial Sequence: Synthetic oligonucleotide"
ggccuguauuggagacagaua

SEQ ID NO: 3729 - RNA, 21 nt, Artificial Sequence
  source: /note="Description of Artificial Sequence: Synthetic oligonucleotide"
uuggagacagaugaagucgua

SEQ ID NO: 3730 - RNA, 21 nt, Artificial Sequence
  source: /note="Description of Artificial Sequence: Synthetic oligonucleotide"
acagaugaagucguaagaagu

SEQ ID NO: 3731 - RNA, 21 nt, Artificial Sequence
  source: /note="Description of Artificial Sequence: Synthetic oligonucleotide"
cagaugaagucguaagaagua

SEQ ID NO: 3732 - RNA, 21 nt, Artificial Sequence
  source: /note="Description of Artificial Sequence: Synthetic oligonucleotide"
agaugaagucguaagaagucu

SEQ ID NO: 3733 - RNA, 21 nt, Artificial Sequence
  source: /note="Description of Artificial Sequence: Synthetic oligonucleotide"
gaugaagucguaagaagucua

SEQ ID NO: 3734 - RNA, 21 nt, Artificial Sequence
  source: /note="Description of Artificial Sequence: Synthetic oligonucleotide"
gaagucguaagaagucugaua

SEQ ID NO: 3735 - RNA, 21 nt, Artificial Sequence
  source: /note="Description of Artificial Sequence: Synthetic oligonucleotide"
agucguaagaagucugauaga

SEQ ID NO: 3736 - RNA, 21 nt, Artificial Sequence
  source: /note="Description of Artificial Sequence: Synthetic oligonucleotide"
uaagaagucugauagauggaa

SEQ ID NO: 3737 - RNA, 21 nt, Artificial Sequence
  source: /note="Description of Artificial Sequence: Synthetic oligonucleotide"
aagaagucugauagauggaau

SEQ ID NO: 3738 - RNA, 21 nt, Artificial Sequence
  source: /note="Description of Artificial Sequence: Synthetic oligonucleotide"
gaagucugauagauggaauaa

SEQ ID NO: 3739 - RNA, 21 nt, Artificial Sequence
  source: /note="Description of Artificial Sequence: Synthetic oligonucleotide"
aagucugauagauggaauacu

SEQ ID NO: 3740 - RNA, 21 nt, Artificial Sequence
  source: /note="Description of Artificial Sequence: Synthetic oligonucleotide"
uggaauacuuaccaauaagaa

SEQ ID NO: 3741 - RNA, 21 nt, Artificial Sequence
  source: /note="Description of Artificial Sequence: Synthetic oligonucleotide"
aaugauuuuuguuccaucgua

SEQ ID NO: 3742 - RNA, 21 nt, Artificial Sequence
  source: /note="Description of Artificial Sequence: Synthetic oligonucleotide"
augauuuuuguuccaucguau

SEQ ID NO: 3743 - RNA, 21 nt, Artificial Sequence
  source: /note="Description of Artificial Sequence: Synthetic oligonucleotide"
auuuuuguuccaucguauaua

SEQ ID NO: 3744 - RNA, 21 nt, Artificial Sequence
  source: /note="Description of Artificial Sequence: Synthetic oligonucleotide"
uuguuccaucguauaucaaua

SEQ ID NO: 3745 - RNA, 21 nt, Artificial Sequence
  source: /note="Description of Artificial Sequence: Synthetic oligonucleotide"
guuccaucguauaucaauaua

SEQ ID NO: 3746 - RNA, 21 nt, Artificial Sequence
  source: /note="Description of Artificial Sequence: Synthetic oligonucleotide"
uuccaucguauaucaauaucu

SEQ ID NO: 3747 - RNA, 21 nt, Artificial Sequence
  source: /note="Description of Artificial Sequence: Synthetic oligonucleotide"
uccaucguauaucaauaucuu

SEQ ID NO: 3748 - RNA, 21 nt, Artificial Sequence
  source: /note="Description of Artificial Sequence: Synthetic oligonucleotide"
ccaucguauaucaauaucuuu

SEQ ID NO: 3749 - RNA, 21 nt, Artificial Sequence
  source: /note="Description of Artificial Sequence: Synthetic oligonucleotide"
acagaaguuucuuccugaaca

SEQ ID NO: 3750 - RNA, 21 nt, Artificial Sequence
  source: /note="Description of Artificial Sequence: Synthetic oligonucleotide"
agaaguuucuuccugaacgca

SEQ ID NO: 3751 - RNA, 21 nt, Artificial Sequence
  source: /note="Description of Artificial Sequence: Synthetic oligonucleotide"
aaguuucuuccugaacgcgca

SEQ ID NO: 3752 - RNA, 21 nt, Artificial Sequence
  source: /note="Description of Artificial Sequence: Synthetic oligonucleotide"
guuucuuccugaacgcgccua

SEQ ID NO: 3753 - RNA, 21 nt, Artificial Sequence
  source: /note="Description of Artificial Sequence: Synthetic oligonucleotide"
ucuuccugaacgcgccucaga

SEQ ID NO: 3754 - RNA, 21 nt, Artificial Sequence
  source: /note="Description of Artificial Sequence: Synthetic oligonucleotide"
ccucagcgauuuuaaaucgua

SEQ ID NO: 3755 - RNA, 21 nt, Artificial Sequence
  source: /note="Description of Artificial Sequence: Synthetic oligonucleotide"
cucagcgauuuuaaaucguau

SEQ ID NO: 3756 - RNA, 21 nt, Artificial Sequence
  source: /note="Description of Artificial Sequence: Synthetic oligonucleotide"
ucagcgauuuuaaaucguaua

SEQ ID NO: 3757 - RNA, 21 nt, Artificial Sequence
  source: /note="Description of Artificial Sequence: Synthetic oligonucleotide"
cagcgauuuuaaaucguauga

SEQ ID NO: 3758 - RNA, 21 nt, Artificial Sequence
  source: /note="Description of Artificial Sequence: Synthetic oligonucleotide"
agcgauuuuaaaucguaugca

SEQ ID NO: 3759 - RNA, 21 nt, Artificial Sequence
  source: /note="Description of Artificial Sequence: Synthetic oligonucleotide"
gcgauuuuaaaucguaugcaa

SEQ ID NO: 3760 - RNA, 21 nt, Artificial Sequence
  source: /note="Description of Artificial Sequence: Synthetic oligonucleotide"
cgauuuuaaaucguaugcaga

SEQ ID NO: 3761 - RNA, 21 nt, Artificial Sequence
  source: /note="Description of Artificial Sequence: Synthetic oligonucleotide"
gauuuuaaaucguaugcagaa

SEQ ID NO: 3762 - RNA, 21 nt, Artificial Sequence
  source: /note="Description of Artificial Sequence: Synthetic oligonucleotide"
auuuuaaaucguaugcagaau

SEQ ID NO: 3763 - RNA, 21 nt, Artificial Sequence
  source: /note="Description of Artificial Sequence: Synthetic oligonucleotide"
uuuuaaaucguaugcagaaua

SEQ ID NO: 3764 - RNA, 21 nt, Artificial Sequence
  source: /note="Description of Artificial Sequence: Synthetic oligonucleotide"
aaaucguaugcagaauauuca

SEQ ID NO: 3765 - RNA, 21 nt, Artificial Sequence
  source: /note="Description of Artificial Sequence: Synthetic oligonucleotide"
aucguaugcagaauauucaau

SEQ ID NO: 3766 - RNA, 21 nt, Artificial Sequence
  source: /note="Description of Artificial Sequence: Synthetic oligonucleotide"
uauucaauuugaagcaguggu

SEQ ID NO: 3767 - RNA, 21 nt, Artificial Sequence
  source: /note="Description of Artificial Sequence: Synthetic oligonucleotide"
gaauaaauaagcuccagccaa

SEQ ID NO: 3768 - RNA, 21 nt, Artificial Sequence
  source: /note="Description of Artificial Sequence: Synthetic oligonucleotide"
aauaaauaagcuccagccaga

SEQ ID NO: 3769 - RNA, 21 nt, Artificial Sequence
  source: /note="Description of Artificial Sequence: Synthetic oligonucleotide"
agccagagauguaugcaugau

SEQ ID NO: 3770 - RNA, 21 nt, Artificial Sequence
  source: /note="Description of Artificial Sequence: Synthetic oligonucleotide"
gccagagauguaugcaugaua

SEQ ID NO: 3771 - RNA, 21 nt, Artificial Sequence
  source: /note="Description of Artificial Sequence: Synthetic oligonucleotide"
auaugaauaguuucgaaucaa

SEQ ID NO: 3772 - RNA, 21 nt, Artificial Sequence
  source: /note="Description of Artificial Sequence: Synthetic oligonucleotide"
uaugaauaguuucgaaucaau

SEQ ID NO: 3773 - RNA, 21 nt, Artificial Sequence
  source: /note="Description of Artificial Sequence: Synthetic oligonucleotide"
aauaguuucgaaucaaugcua

SEQ ID NO: 3774 - RNA, 21 nt, Artificial Sequence
  source: /note="Description of Artificial Sequence: Synthetic oligonucleotide"
uucaguccugauaauauuaaa

SEQ ID NO: 3775 - RNA, 21 nt, Artificial Sequence
  source: /note="Description of Artificial Sequence: Synthetic oligonucleotide"
aaaaacauugguuuggcacua

SEQ ID NO: 3776 - RNA, 21 nt, Artificial Sequence
  source: /note="Description of Artificial Sequence: Synthetic oligonucleotide"
aaaacauugguuuggcacuaa

SEQ ID NO: 3777 - RNA, 21 nt, Artificial Sequence
  source: /note="Description of Artificial Sequence: Synthetic oligonucleotide"
gucaaacgaacaagauuaauu

SEQ ID NO: 3778 - RNA, 21 nt, Artificial Sequence
  source: /note="Description of Artificial Sequence: Synthetic oligonucleotide"
aaacgaacaagauuaauuaca

SEQ ID NO: 3779 - RNA, 21 nt, Artificial Sequence
  source: /note="Description of Artificial Sequence: Synthetic oligonucleotide"
aacgaacaagauuaauuaccu

SEQ ID NO: 3780 - RNA, 21 nt, Artificial Sequence
  source: /note="Description of Artificial Sequence: Synthetic oligonucleotide"
acgaacaagauuaauuaccua

SEQ ID NO: 3781 - RNA, 21 nt, Artificial Sequence
  source: /note="Description of Artificial Sequence: Synthetic oligonucleotide"
cgaacaagauuaauuaccugu

SEQ ID NO: 3782 - RNA, 21 nt, Artificial Sequence
  source: /note="Description of Artificial Sequence: Synthetic oligonucleotide"
ucucaagaauauuuacguagu

SEQ ID NO: 3783 - RNA, 21 nt, Artificial Sequence
  source: /note="Description of Artificial Sequence: Synthetic oligonucleotide"
ucaagaauauuuacguaguuu

SEQ ID NO: 3784 - RNA, 21 nt, Artificial Sequence
  source: /note="Description of Artificial Sequence: Synthetic oligonucleotide"
caagaauauuuacguaguuuu

SEQ ID NO: 3785 - RNA, 21 nt, Artificial Sequence
  source: /note="Description of Artificial Sequence: Synthetic oligonucleotide"
uuucauaggucuguuuuuccu

SEQ ID NO: 3786 - RNA, 21 nt, Artificial Sequence
  source: /note="Description of Artificial Sequence: Synthetic oligonucleotide"
uucaugccucuuaaaaacuua

SEQ ID NO: 3787 - RNA, 21 nt, Artificial Sequence
  source: /note="Description of Artificial Sequence: Synthetic oligonucleotide"
aaaaacuucugugcuuacaua

SEQ ID NO: 3788 - RNA, 21 nt, Artificial Sequence
  source: /note="Description of Artificial Sequence: Synthetic oligonucleotide"
aaaacuucugugcuuacauaa

SEQ ID NO: 3789 - RNA, 21 nt, Artificial Sequence
  source: /note="Description of Artificial Sequence: Synthetic oligonucleotide"
aaacuucugugcuuacauaaa

SEQ ID NO: 3790 - RNA, 21 nt, Artificial Sequence
  source: /note="Description of Artificial Sequence: Synthetic oligonucleotide"
uuuuuccauuuaaagguggaa

SEQ ID NO: 3791 - RNA, 21 nt, Artificial Sequence
  source: /note="Description of Artificial Sequence: Synthetic oligonucleotide"
cuaccucccuaaaaguaaaua

SEQ ID NO: 3792 - RNA, 21 nt, Artificial Sequence
  source: /note="Description of Artificial Sequence: Synthetic oligonucleotide"
uaccucccuaaaaguaaauaa

SEQ ID NO: 3793 - RNA, 21 nt, Artificial Sequence
  source: /note="Description of Artificial Sequence: Synthetic oligonucleotide"
uacaaagagaacuuauuuaca

SEQ ID NO: 3794 - RNA, 21 nt, Artificial Sequence
  source: /note="Description of Artificial Sequence: Synthetic oligonucleotide"
aacuuauuuacacagggaaga

SEQ ID NO: 3795 - RNA, 21 nt, Artificial Sequence
  source: /note="Description of Artificial Sequence: Synthetic oligonucleotide"
uuacacagggaagguuuaaga

SEQ ID NO: 3796 - RNA, 21 nt, Artificial Sequence
  source: /note="Description of Artificial Sequence: Synthetic oligonucleotide"
uacacagggaagguuuaagaa

SEQ ID NO: 3797 - RNA, 21 nt, Artificial Sequence
  source: /note="Description of Artificial Sequence: Synthetic oligonucleotide"
acacagggaagguuuaagacu

SEQ ID NO: 3798 - RNA, 21 nt, Artificial Sequence
  source: /note="Description of Artificial Sequence: Synthetic oligonucleotide"
agguuuaagacuguucaagua

SEQ ID NO: 3799 - RNA, 21 nt, Artificial Sequence
  source: /note="Description of Artificial Sequence: Synthetic oligonucleotide"
uuuaagacuguucaaguagca

SEQ ID NO: 3800 - RNA, 21 nt, Artificial Sequence
  source: /note="Description of Artificial Sequence: Synthetic oligonucleotide"
uaagacuguucaaguagcauu

SEQ ID NO: 3801 - RNA, 21 nt, Artificial Sequence
  source: /note="Description of Artificial Sequence: Synthetic oligonucleotide"
agacuguucaaguagcauuca

SEQ ID NO: 3802 - RNA, 21 nt, Artificial Sequence
  source: /note="Description of Artificial Sequence: Synthetic oligonucleotide"
cuguucaaguagcauuccaau

SEQ ID NO: 3803 - RNA, 21 nt, Artificial Sequence
  source: /note="Description of Artificial Sequence: Synthetic oligonucleotide"
guucaaguagcauuccaaucu

SEQ ID NO: 3804 - RNA, 21 nt, Artificial Sequence
  source: /note="Description of Artificial Sequence: Synthetic oligonucleotide"
uucaaguagcauuccaaucua

SEQ ID NO: 3805 - RNA, 21 nt, Artificial Sequence
  source: /note="Description of Artificial Sequence: Synthetic oligonucleotide"
uagcauuccaaucuguagcca

SEQ ID NO: 3806 - RNA, 21 nt, Artificial Sequence
  source: /note="Description of Artificial Sequence: Synthetic oligonucleotide"
agcauuccaaucuguagccau

SEQ ID NO: 3807 - RNA, 21 nt, Artificial Sequence
  source: /note="Description of Artificial Sequence: Synthetic oligonucleotide"
gcauuccaaucuguagccaua

SEQ ID NO: 3808 - RNA, 21 nt, Artificial Sequence
  source: /note="Description of Artificial Sequence: Synthetic oligonucleotide"
gccaugccacagaauaucaaa

SEQ ID NO: 3809 - RNA, 21 nt, Artificial Sequence
  source: /note="Description of Artificial Sequence: Synthetic oligonucleotide"
ccaugccacagaauaucaaca

SEQ ID NO: 3810 - RNA, 21 nt, Artificial Sequence
  source: /note="Description of Artificial Sequence: Synthetic oligonucleotide"
aagaacacagaaugagugcaa

SEQ ID NO: 3811 - RNA, 21 nt, Artificial Sequence
  source: /note="Description of Artificial Sequence: Synthetic oligonucleotide"
guuucagcaggcagcuuuaua

SEQ ID NO: 3812 - RNA, 21 nt, Artificial Sequence
  source: /note="Description of Artificial Sequence: Synthetic oligonucleotide"
uuucagcaggcagcuuuaucu

SEQ ID NO: 3813 - RNA, 21 nt, Artificial Sequence
  source: /note="Description of Artificial Sequence: Synthetic oligonucleotide"
gcagcuuuaucucaaccugga

SEQ ID NO: 3814 - RNA, 21 nt, Artificial Sequence
  source: /note="Description of Artificial Sequence: Synthetic oligonucleotide"
aucucaaccuggacauauuuu

SEQ ID NO: 3815 - RNA, 21 nt, Artificial Sequence
  source: /note="Description of Artificial Sequence: Synthetic oligonucleotide"
auuugaaagauuucccuagca

SEQ ID NO: 3816 - RNA, 21 nt, Artificial Sequence
  source: /note="Description of Artificial Sequence: Synthetic oligonucleotide"
uugaaagauuucccuagccua

SEQ ID NO: 3817 - RNA, 21 nt, Artificial Sequence
  source: /note="Description of Artificial Sequence: Synthetic oligonucleotide"
ugaaagauuucccuagccucu

SEQ ID NO: 3818 - RNA, 21 nt, Artificial Sequence
  source: /note="Description of Artificial Sequence: Synthetic oligonucleotide"
gaaagauuucccuagccucuu

SEQ ID NO: 3819 - RNA, 21 nt, Artificial Sequence
  source: /note="Description of Artificial Sequence: Synthetic oligonucleotide"
cauuagcccaaaacggugcaa

SEQ ID NO: 3820 - RNA, 21 nt, Artificial Sequence
  source: /note="Description of Artificial Sequence: Synthetic oligonucleotide"
auuagcccaaaacggugcaaa

SEQ ID NO: 3821 - RNA, 21 nt, Artificial Sequence
  source: /note="Description of Artificial Sequence: Synthetic oligonucleotide"
uuagcccaaaacggugcaacu

SEQ ID NO: 3822 - RNA, 21 nt, Artificial Sequence
  source: /note="Description of Artificial Sequence: Synthetic oligonucleotide"
uagcccaaaacggugcaacua

SEQ ID NO: 3823 - RNA, 21 nt, Artificial Sequence
  source: /note="Description of Artificial Sequence: Synthetic oligonucleotide"
agcccaaaacggugcaacucu

SEQ ID NO: 3824 - RNA, 21 nt, Artificial Sequence
  source: /note="Description of Artificial Sequence: Synthetic oligonucleotide"
gcccaaaacggugcaacucua

SEQ ID NO: 3825 - RNA, 21 nt, Artificial Sequence
  source: /note="Description of Artificial Sequence: Synthetic oligonucleotide"
ccaaaacggugcaacucuauu

SEQ ID NO: 3826 - RNA, 21 nt, Artificial Sequence
  source: /note="Description of Artificial Sequence: Synthetic oligonucleotide"
aaaacggugcaacucuauucu

SEQ ID NO: 3827 - RNA, 21 nt, Artificial Sequence
  source: /note="Description of Artificial Sequence: Synthetic oligonucleotide"
aaacggugcaacucuauucua

SEQ ID NO: 3828 - RNA, 21 nt, Artificial Sequence
  source: /note="Description of Artificial Sequence: Synthetic oligonucleotide"
aacggugcaacucuauucuga

SEQ ID NO: 3829 - RNA, 21 nt, Artificial Sequence
  source: /note="Description of Artificial Sequence: Synthetic oligonucleotide"
ggugcaacucuauucuggacu

SEQ ID NO: 3830 - RNA, 21 nt, Artificial Sequence
  source: /note="Description of Artificial Sequence: Synthetic oligonucleotide"
ugcaacucuauucuggacuuu

SEQ ID NO: 3831 - RNA, 21 nt, Artificial Sequence
  source: /note="Description of Artificial Sequence: Synthetic oligonucleotide"
caacucuauucuggacuuuau

SEQ ID NO: 3832 - RNA, 21 nt, Artificial Sequence
  source: /note="Description of Artificial Sequence: Synthetic oligonucleotide"
aacucuauucuggacuuuauu

SEQ ID NO: 3833 - RNA, 21 nt, Artificial Sequence
  source: /note="Description of Artificial Sequence: Synthetic oligonucleotide"
auucuggacuuuauuacuuga

SEQ ID NO: 3834 - RNA, 21 nt, Artificial Sequence
  source: /note="Description of Artificial Sequence: Synthetic oligonucleotide"
uguauaacucugaaguccaca

SEQ ID NO: 3835 - RNA, 21 nt, Artificial Sequence
  source: /note="Description of Artificial Sequence: Synthetic oligonucleotide"
guauaacucugaaguccacca

SEQ ID NO: 3836 - RNA, 21 nt, Artificial Sequence
  source: /note="Description of Artificial Sequence: Synthetic oligonucleotide"
gaaguccaccaaaaguggaca

SEQ ID NO: 3837 - RNA, 21 nt, Artificial Sequence
  source: /note="Description of Artificial Sequence: Synthetic oligonucleotide"
guccaccaaaaguggacccua

SEQ ID NO: 3838 - RNA, 21 nt, Artificial Sequence
  source: /note="Description of Artificial Sequence: Synthetic oligonucleotide"
caccaaaaguggacccucuau

SEQ ID NO: 3839 - RNA, 21 nt, Artificial Sequence
  source: /note="Description of Artificial Sequence: Synthetic oligonucleotide"
accaaaaguggacccucuaua

SEQ ID NO: 3840 - RNA, 21 nt, Artificial Sequence
  source: /note="Description of Artificial Sequence: Synthetic oligonucleotide"
ccaaaaguggacccucuauau

SEQ ID NO: 3841 - RNA, 21 nt, Artificial Sequence
  source: /note="Description of Artificial Sequence: Synthetic oligonucleotide"
aaaaguggacccucuauauuu

SEQ ID NO: 3842 - RNA, 21 nt, Artificial Sequence
  source: /note="Description of Artificial Sequence: Synthetic oligonucleotide"
aaaguggacccucuauauuua

SEQ ID NO: 3843 - RNA, 21 nt, Artificial Sequence
  source: /note="Description of Artificial Sequence: Synthetic oligonucleotide"
aaguggacccucuauauuuca

SEQ ID NO: 3844 - RNA, 21 nt, Artificial Sequence
  source: /note="Description of Artificial Sequence: Synthetic oligonucleotide"
auacauuaugaaaggugacca

SEQ ID NO: 3845 - RNA, 21 nt, Artificial Sequence
  source: /note="Description of Artificial Sequence: Synthetic oligonucleotide"
uacauuaugaaaggugaccga

SEQ ID NO: 3846 - RNA, 21 nt, Artificial Sequence
  source: /note="Description of Artificial Sequence: Synthetic oligonucleotide"
acauuaugaaaggugaccgaa

SEQ ID NO: 3847 - RNA, 21 nt, Artificial Sequence
  source: /note="Description of Artificial Sequence: Synthetic oligonucleotide"
cauuaugaaaggugaccgacu

SEQ ID NO: 3848 - RNA, 21 nt, Artificial Sequence
  source: /note="Description of Artificial Sequence: Synthetic oligonucleotide"
auuaugaaaggugaccgacua

SEQ ID NO: 3849 - RNA, 21 nt, Artificial Sequence
  source: /note="Description of Artificial Sequence: Synthetic oligonucleotide"
aggugaccgacucuauuuuaa

SEQ ID NO: 3850 - RNA, 21 nt, Artificial Sequence
  source: /note="Description of Artificial Sequence: Synthetic oligonucleotide"
aucucagaauuuuaaguucua

SEQ ID NO: 3851 - RNA, 21 nt, Artificial Sequence
  source: /note="Description of Artificial Sequence: Synthetic oligonucleotide"
cuuucauauauccuuggucca

SEQ ID NO: 3852 - RNA, 21 nt, Artificial Sequence
  source: /note="Description of Artificial Sequence: Synthetic oligonucleotide"
uuucauauauccuugguccca

SEQ ID NO: 3853 - RNA, 21 nt, Artificial Sequence
  source: /note="Description of Artificial Sequence: Synthetic oligonucleotide"
uucauauauccuuggucccaa

SEQ ID NO: 3854 - RNA, 21 nt, Artificial Sequence
  source: /note="Description of Artificial Sequence: Synthetic oligonucleotide"
gucccagagauguuuagacaa

SEQ ID NO: 3855 - RNA, 21 nt, Artificial Sequence
  source: /note="Description of Artificial Sequence: Synthetic oligonucleotide"
cagagauguuuagacaauuuu

SEQ ID NO: 3856 - RNA, 21 nt, Artificial Sequence
  source: /note="Description of Artificial Sequence: Synthetic oligonucleotide"
agagauguuuagacaauuuua

SEQ ID NO: 3857 - RNA, 21 nt, Artificial Sequence
  source: /note="Description of Artificial Sequence: Synthetic oligonucleotide"
guuuagacaauuuuaggcuca

SEQ ID NO: 3858 - RNA, 21 nt, Artificial Sequence
  source: /note="Description of Artificial Sequence: Synthetic oligonucleotide"
uuuagacaauuuuaggcucaa

SEQ ID NO: 3859 - RNA, 21 nt, Artificial Sequence
  source: /note="Description of Artificial Sequence: Synthetic oligonucleotide"
uuagacaauuuuaggcucaaa

SEQ ID NO: 3860 - RNA, 21 nt, Artificial Sequence
  source: /note="Description of Artificial Sequence: Synthetic oligonucleotide"
uagacaauuuuaggcucaaaa

SEQ ID NO: 3861 - RNA, 21 nt, Artificial Sequence
  source: /note="Description of Artificial Sequence: Synthetic oligonucleotide"
agacaauuuuaggcucaaaaa

SEQ ID NO: 3862 - RNA, 21 nt, Artificial Sequence
  source: /note="Description of Artificial Sequence: Synthetic oligonucleotide"
acaauuuuaggcucaaaaauu

SEQ ID NO: 3863 - RNA, 21 nt, Artificial Sequence
  source: /note="Description of Artificial Sequence: Synthetic oligonucleotide"
uuuaggcucaaaaauuaaaga

SEQ ID NO: 3864 - RNA, 21 nt, Artificial Sequence
  source: /note="Description of Artificial Sequence: Synthetic oligonucleotide"
uuaggcucaaaaauuaaagcu

SEQ ID NO: 3865 - RNA, 21 nt, Artificial Sequence
  source: /note="Description of Artificial Sequence: Synthetic oligonucleotide"
uaggcucaaaaauuaaagcua

SEQ ID NO: 3866 - RNA, 21 nt, Artificial Sequence
  source: /note="Description of Artificial Sequence: Synthetic oligonucleotide"
caggaaaaggaacuguacuga

SEQ ID NO: 3867 - RNA, 21 nt, Artificial Sequence
  source: /note="Description of Artificial Sequence: Synthetic oligonucleotide"
ggaaaaggaacuguacuggcu

SEQ ID NO: 3868 - RNA, 21 nt, Artificial Sequence
  source: /note="Description of Artificial Sequence: Synthetic oligonucleotide"
aaaaggaacuguacuggcuau

SEQ ID NO: 3869 - RNA, 21 nt, Artificial Sequence
  source: /note="Description of Artificial Sequence: Synthetic oligonucleotide"
aggaacuguacuggcuauuaa

SEQ ID NO: 3870 - RNA, 21 nt, Artificial Sequence
  source: /note="Description of Artificial Sequence: Synthetic oligonucleotide"
ggaacuguacuggcuauuaca

SEQ ID NO: 3871 - RNA, 21 nt, Artificial Sequence
  source: /note="Description of Artificial Sequence: Synthetic oligonucleotide"
uaauccgacucccacuacaua

SEQ ID NO: 3872 - RNA, 21 nt, Artificial Sequence
  source: /note="Description of Artificial Sequence: Synthetic oligonucleotide"
uccgacucccacuacaucaaa

SEQ ID NO: 3873 - RNA, 21 nt, Artificial Sequence
  source: /note="Description of Artificial Sequence: Synthetic oligonucleotide"
cucccacuacaucaagacuaa

SEQ ID NO: 3874 - RNA, 21 nt, Artificial Sequence
  source: /note="Description of Artificial Sequence: Synthetic oligonucleotide"
ucccacuacaucaagacuaau

SEQ ID NO: 3875 - RNA, 21 nt, Artificial Sequence
  source: /note="Description of Artificial Sequence: Synthetic oligonucleotide"
cccacuacaucaagacuaaua

SEQ ID NO: 3876 - RNA, 21 nt, Artificial Sequence
  source: /note="Description of Artificial Sequence: Synthetic oligonucleotide"
ccacuacaucaagacuaaucu

SEQ ID NO: 3877 - RNA, 21 nt, Artificial Sequence
  source: /note="Description of Artificial Sequence: Synthetic oligonucleotide"
acuacaucaagacuaaucuua

SEQ ID NO: 3878 - RNA, 21 nt, Artificial Sequence
  source: /note="Description of Artificial Sequence: Synthetic oligonucleotide"
cuacaucaagacuaaucuugu

SEQ ID NO: 3879 - RNA, 21 nt, Artificial Sequence
  source: /note="Description of Artificial Sequence: Synthetic oligonucleotide"
uacaucaagacuaaucuuguu

SEQ ID NO: 3880 - RNA, 21 nt, Artificial Sequence
  source: /note="Description of Artificial Sequence: Synthetic oligonucleotide"
acaucaagacuaaucuuguuu

SEQ ID NO: 3881 - RNA, 21 nt, Artificial Sequence
  source: /note="Description of Artificial Sequence: Synthetic oligonucleotide"
guauuauagaaugcuuuugca

SEQ ID NO: 3882 - RNA, 21 nt, Artificial Sequence
  source: /note="Description of Artificial Sequence: Synthetic oligonucleotide"
uauagaaugcuuuugcaugga

SEQ ID NO: 3883 - RNA, 21 nt, Artificial Sequence
  source: /note="Description of Artificial Sequence: Synthetic oligonucleotide"
agaaugcuuuugcauggacua

SEQ ID NO: 3884 - RNA, 21 nt, Artificial Sequence
  source: /note="Description of Artificial Sequence: Synthetic oligonucleotide"
gaaugcuuuugcauggacuau

SEQ ID NO: 3885 - RNA, 21 nt, Artificial Sequence
  source: /note="Description of Artificial Sequence: Synthetic oligonucleotide"
ugcuuuugcauggacuauccu

SEQ ID NO: 3886 - RNA, 21 nt, Artificial Sequence
  source: /note="Description of Artificial Sequence: Synthetic oligonucleotide"
cuuuugcauggacuauccucu

SEQ ID NO: 3887 - RNA, 21 nt, Artificial Sequence
  source: /note="Description of Artificial Sequence: Synthetic oligonucleotide"
ugcauggacuauccucuuguu

SEQ ID NO: 3888 - RNA, 21 nt, Artificial Sequence
  source: /note="Description of Artificial Sequence: Synthetic oligonucleotide"
gcauggacuauccucuuguuu

SEQ ID NO: 3889 - RNA, 21 nt, Artificial Sequence
  source: /note="Description of Artificial Sequence: Synthetic oligonucleotide"
aaauaaccucuuguaguuaua

SEQ ID NO: 3890 - RNA, 21 nt, Artificial Sequence
  source: /note="Description of Artificial Sequence: Synthetic oligonucleotide"
aaccucuuguaguuauaaaau

SEQ ID NO: 3891 - RNA, 23 nt, Artificial Sequence
  source: /note="Description of Artificial Sequence: Synthetic oligonucleotide"
aguccuagggaggagguacuguc

SEQ ID NO: 3892 - RNA, 23 nt, Artificial Sequence
  source: /note="Description of Artificial Sequence: Synthetic oligonucleotide"
uaguccuagggaggagguacugu

SEQ ID NO: 3893 - RNA, 23 nt, Artificial Sequence
  source: /note="Description of Artificial Sequence: Synthetic oligonucleotide"
uuaguccuagggaggagguacug

SEQ ID NO: 3894 - RNA, 23 nt, Artificial Sequence
  source: /note="Description of Artificial Sequence: Synthetic oligonucleotide"
uugguucaguccuuguguagucc

SEQ ID NO: 3895 - RNA, 23 nt, Artificial Sequence
  source: /note="Description of Artificial Sequence: Synthetic oligonucleotide"
ucugguucaguccuuguguaguc

SEQ ID NO: 3896 - RNA, 23 nt, Artificial Sequence
  source: /note="Description of Artificial Sequence: Synthetic oligonucleotide"
uuucugguucaguccuuguguag

SEQ ID NO: 3897 - RNA, 23 nt, Artificial Sequence
  source: /note="Description of Artificial Sequence: Synthetic oligonucleotide"
uauguucauggcuuugcucuguc

SEQ ID NO: 3898 - RNA, 23 nt, Artificial Sequence
  source: /note="Description of Artificial Sequence: Synthetic oligonucleotide"
ucagaaggauuucuaggaugaug

SEQ ID NO: 3899 - RNA, 23 nt, Artificial Sequence
  source: /note="Description of Artificial Sequence: Synthetic oligonucleotide"
uggugaucagaagcagaaggauu

SEQ ID NO: 3900 - RNA, 23 nt, Artificial Sequence
  source: /note="Description of Artificial Sequence: Synthetic oligonucleotide"
ucaaguaggaguagaugauggug

SEQ ID NO: 3901 - RNA, 23 nt, Artificial Sequence
  source: /note="Description of Artificial Sequence: Synthetic oligonucleotide"
acgacuccaaguaggaguagaug

SEQ ID NO: 3902 - RNA, 23 nt, Artificial Sequence
  source: /note="Description of Artificial Sequence: Synthetic oligonucleotide"
aacgacuccaaguaggaguagau

SEQ ID NO: 3903 - RNA, 23 nt, Artificial Sequence
  source: /note="Description of Artificial Sequence: Synthetic oligonucleotide"
uaacgacuccaaguaggaguaga

SEQ ID NO: 3904 - RNA, 23 nt, Artificial Sequence
  source: /note="Description of Artificial Sequence: Synthetic oligonucleotide"
ucaacgacuccaaguaggaguag

SEQ ID NO: 3905 - RNA, 23 nt, Artificial Sequence
  source: /note="Description of Artificial Sequence: Synthetic oligonucleotide"
accaacgacuccaaguaggagua

SEQ ID NO: 3906 - RNA, 23 nt, Artificial Sequence
  source: /note="Description of Artificial Sequence: Synthetic oligonucleotide"
uaccaacgacuccaaguaggagu

SEQ ID NO: 3907 - RNA, 23 nt, Artificial Sequence
  source: /note="Description of Artificial Sequence: Synthetic oligonucleotide"
augaaaaacuucaccaacgacuc

SEQ ID NO: 3908 - RNA, 23 nt, Artificial Sequence
  source: /note="Description of Artificial Sequence: Synthetic oligonucleotide"
uccaguaaugagaacaaucuccc

SEQ ID NO: 3909 - RNA, 23 nt, Artificial Sequence
  source: /note="Description of Artificial Sequence: Synthetic oligonucleotide"
uagcuccaguaaugagaacaauc

SEQ ID NO: 3910 - RNA, 23 nt, Artificial Sequence
  source: /note="Description of Artificial Sequence: Synthetic oligonucleotide"
ucaaauucauaaguagucugccu

SEQ ID NO: 3911 - RNA, 23 nt, Artificial Sequence
  source: /note="Description of Artificial Sequence: Synthetic oligonucleotide"
ucguuuugcaaauucauaaguag

SEQ ID NO: 3912 - RNA, 23 nt, Artificial Sequence
  source: /note="Description of Artificial Sequence: Synthetic oligonucleotide"
augcucugucguuuugcaaauuc

SEQ ID NO: 3913 - RNA, 23 nt, Artificial Sequence
  source: /note="Description of Artificial Sequence: Synthetic oligonucleotide"
uaugcucugucguuuugcaaauu

SEQ ID NO: 3914 - RNA, 23 nt, Artificial Sequence
  source: /note="Description of Artificial Sequence: Synthetic oligonucleotide"
ucacagaaccaauaugcucuguc

SEQ ID NO: 3915 - RNA, 23 nt, Artificial Sequence
  source: /note="Description of Artificial Sequence: Synthetic oligonucleotide"
uccacagaaccaauaugcucugu

SEQ ID NO: 3916 - RNA, 23 nt, Artificial Sequence
  source: /note="Description of Artificial Sequence: Synthetic oligonucleotide"
ucccacagaaccaauaugcucug

SEQ ID NO: 3917 - RNA, 23 nt, Artificial Sequence
  source: /note="Description of Artificial Sequence: Synthetic oligonucleotide"
ucgcuuauuaauaucccacagaa

SEQ ID NO: 3918 - RNA, 23 nt, Artificial Sequence
  source: /note="Description of Artificial Sequence: Synthetic oligonucleotide"
uuccacaccgcgcuuauuaauau

SEQ ID NO: 3919 - RNA, 23 nt, Artificial Sequence
  source: /note="Description of Artificial Sequence: Synthetic oligonucleotide"
ucuccacaccgcgcuuauuaaua

SEQ ID NO: 3920 - RNA, 23 nt, Artificial Sequence
  source: /note="Description of Artificial Sequence: Synthetic oligonucleotide"
uucggcacucagcugcaguuucc

SEQ ID NO: 3921 - RNA, 23 nt, Artificial Sequence
  source: /note="Description of Artificial Sequence: Synthetic oligonucleotide"
uuucggcacucagcugcaguuuc

SEQ ID NO: 3922 - RNA, 23 nt, Artificial Sequence
  source: /note="Description of Artificial Sequence: Synthetic oligonucleotide"
uuuucggcacucagcugcaguuu

SEQ ID NO: 3923 - RNA, 23 nt, Artificial Sequence
  source: /note="Description of Artificial Sequence: Synthetic oligonucleotide"
guuuucggcacucagcugcaguu

SEQ ID NO: 3924 - RNA, 23 nt, Artificial Sequence
  source: /note="Description of Artificial Sequence: Synthetic oligonucleotide"
aguuuucggcacucagcugcagu

SEQ ID NO: 3925 - RNA, 23 nt, Artificial Sequence
  source: /note="Description of Artificial Sequence: Synthetic oligonucleotide"
uaguuuucggcacucagcugcag

SEQ ID NO: 3926 - RNA, 23 nt, Artificial Sequence
  source: /note="Description of Artificial Sequence: Synthetic oligonucleotide"
uuaguuuucggcacucagcugca

SEQ ID NO: 3927 - RNA, 23 nt, Artificial Sequence
  source: /note="Description of Artificial Sequence: Synthetic oligonucleotide"
uccuaguuuucggcacucagcug

SEQ ID NO: 3928 - RNA, 23 nt, Artificial Sequence
  source: /note="Description of Artificial Sequence: Synthetic oligonucleotide"
ugccuaguuuucggcacucagcu

SEQ ID NO: 3929 - RNA, 23 nt, Artificial Sequence
  source: /note="Description of Artificial Sequence: Synthetic oligonucleotide"
acgccuaguuuucggcacucagc

SEQ ID NO: 3930 - RNA, 23 nt, Artificial Sequence
  source: /note="Description of Artificial Sequence: Synthetic oligonucleotide"
uacgccuaguuuucggcacucag

SEQ ID NO: 3931 - RNA, 23 nt, Artificial Sequence
  source: /note="Description of Artificial Sequence: Synthetic oligonucleotide"
ugacgccuaguuuucggcacuca

SEQ ID NO: 3932 - RNA, 23 nt, Artificial Sequence
  source: /note="Description of Artificial Sequence: Synthetic oligonucleotide"
uugacgccuaguuuucggcacuc

SEQ ID NO: 3933 - RNA, 23 nt, Artificial Sequence
  source: /note="Description of Artificial Sequence: Synthetic oligonucleotide"
agugacgccuaguuuucggcacu

SEQ ID NO: 3934 - RNA, 23 nt, Artificial Sequence
  source: /note="Description of Artificial Sequence: Synthetic oligonucleotide"
uagugacgccuaguuuucggcac

SEQ ID NO: 3935 - RNA, 23 nt, Artificial Sequence
  source: /note="Description of Artificial Sequence: Synthetic oligonucleotide"
ucagugacgccuaguuuucggca

SEQ ID NO: 3936 - RNA, 23 nt, Artificial Sequence
  source: /note="Description of Artificial Sequence: Synthetic oligonucleotide"
ugcagugacgccuaguuuucggc

SEQ ID NO: 3937 - RNA, 23 nt, Artificial Sequence
  source: /note="Description of Artificial Sequence: Synthetic oligonucleotide"
ugcgcagugacgccuaguuuucg

SEQ ID NO: 3938 - RNA, 23 nt, Artificial Sequence
  source: /note="Description of Artificial Sequence: Synthetic oligonucleotide"
uaugcgcagugacgccuaguuuu

SEQ ID NO: 3939 - RNA, 23 nt, Artificial Sequence
  source: /note="Description of Artificial Sequence: Synthetic oligonucleotide"
ucaugcgcagugacgccuaguuu

SEQ ID NO: 3940 - RNA, 23 nt, Artificial Sequence
  source: /note="Description of Artificial Sequence: Synthetic oligonucleotide"
auacgcaugcgcagugacgccua

SEQ ID NO: 3941 - RNA, 23 nt, Artificial Sequence
  source: /note="Description of Artificial Sequence: Synthetic oligonucleotide"
uagucuaccacauacgcaugcgc

SEQ ID NO: 3942 - RNA, 23 nt, Artificial Sequence
  source: /note="Description of Artificial Sequence: Synthetic oligonucleotide"
ucagucuaccacauacgcaugcg

SEQ ID NO: 3943 - RNA, 23 nt, Artificial Sequence
  source: /note="Description of Artificial Sequence: Synthetic oligonucleotide"
ucgauagaucucuucucuguugc

SEQ ID NO: 3944 - RNA, 23 nt, Artificial Sequence
  source: /note="Description of Artificial Sequence: Synthetic oligonucleotide"
agcgauagaucucuucucuguug

SEQ ID NO: 3945 - RNA, 23 nt, Artificial Sequence
  source: /note="Description of Artificial Sequence: Synthetic oligonucleotide"
uagcgauagaucucuucucuguu

SEQ ID NO: 3946 - RNA, 23 nt, Artificial Sequence
  source: /note="Description of Artificial Sequence: Synthetic oligonucleotide"
agagcgauagaucucuucucugu

SEQ ID NO: 3947 - RNA, 23 nt, Artificial Sequence
  source: /note="Description of Artificial Sequence: Synthetic oligonucleotide"
uagagcgauagaucucuucucug

SEQ ID NO: 3948 - RNA, 23 nt, Artificial Sequence
  source: /note="Description of Artificial Sequence: Synthetic oligonucleotide"
uagagagcgauagaucucuucuc

SEQ ID NO: 3949 - RNA, 23 nt, Artificial Sequence
  source: /note="Description of Artificial Sequence: Synthetic oligonucleotide"
uuagagagcgauagaucucuucu

SEQ ID NO: 3950 - RNA, 23 nt, Artificial Sequence
  source: /note="Description of Artificial Sequence: Synthetic oligonucleotide"
uuuagagagcgauagaucucuuc

SEQ ID NO: 3951 - RNA, 23 nt, Artificial Sequence
  source: /note="Description of Artificial Sequence: Synthetic oligonucleotide"
ugauuuagagagcgauagaucuc

SEQ ID NO: 3952 - RNA, 23 nt, Artificial Sequence
  source: /note="Description of Artificial Sequence: Synthetic oligonucleotide"
uugauuuagagagcgauagaucu

SEQ ID NO: 3953 - RNA, 23 nt, Artificial Sequence
  source: /note="Description of Artificial Sequence: Synthetic oligonucleotide"
accugauuuagagagcgauagau

SEQ ID NO: 3954 - RNA, 23 nt, Artificial Sequence
  source: /note="Description of Artificial Sequence: Synthetic oligonucleotide"
uaccugauuuagagagcgauaga

SEQ ID NO: 3955 - RNA, 23 nt, Artificial Sequence
  source: /note="Description of Artificial Sequence: Synthetic oligonucleotide"
ucaccugauuuagagagcgauag

SEQ ID NO: 3956 - RNA, 23 nt, Artificial Sequence
  source: /note="Description of Artificial Sequence: Synthetic oligonucleotide"
auucaccacgauuguuacaucac

SEQ ID NO: 3957 - RNA, 23 nt, Artificial Sequence
  source: /note="Description of Artificial Sequence: Synthetic oligonucleotide"
uauucaccacgauuguuacauca

SEQ ID NO: 3958 - RNA, 23 nt, Artificial Sequence
  source: /note="Description of Artificial Sequence: Synthetic oligonucleotide"
uuauucaccacgauuguuacauc

SEQ ID NO: 3959 - RNA, 23 nt, Artificial Sequence
  source: /note="Description of Artificial Sequence: Synthetic oligonucleotide"
auuauucaccacgauuguuacau

SEQ ID NO: 3960 - RNA, 23 nt, Artificial Sequence
  source: /note="Description of Artificial Sequence: Synthetic oligonucleotide"
acugucccagcauuauucaccac

SEQ ID NO: 3961 - RNA, 23 nt, Artificial Sequence
  source: /note="Description of Artificial Sequence: Synthetic oligonucleotide"
uuggauauacugucccagcauua

SEQ ID NO: 3962 - RNA, 23 nt, Artificial Sequence
  source: /note="Description of Artificial Sequence: Synthetic oligonucleotide"
ucuggauauacugucccagcauu

SEQ ID NO: 3963 - RNA, 23 nt, Artificial Sequence
  source: /note="Description of Artificial Sequence: Synthetic oligonucleotide"
ugcuggauauacugucccagcau

SEQ ID NO: 3964 - RNA, 23 nt, Artificial Sequence
  source: /note="Description of Artificial Sequence: Synthetic oligonucleotide"
ucggcuggauauacugucccagc

SEQ ID NO: 3965 - RNA, 23 nt, Artificial Sequence
  source: /note="Description of Artificial Sequence: Synthetic oligonucleotide"
aucggcuggauauacugucccag

SEQ ID NO: 3966 - RNA, 23 nt, Artificial Sequence
  source: /note="Description of Artificial Sequence: Synthetic oligonucleotide"
uaucggcuggauauacuguccca

SEQ ID NO: 3967 - RNA, 23 nt, Artificial Sequence
  source: /note="Description of Artificial Sequence: Synthetic oligonucleotide"
uaagaucggcuggauauacuguc

SEQ ID NO: 3968 - RNA, 23 nt, Artificial Sequence
  source: /note="Description of Artificial Sequence: Synthetic oligonucleotide"
uuuggugcugagaagaucggcug

SEQ ID NO: 3969 - RNA, 23 nt, Artificial Sequence
  source: /note="Description of Artificial Sequence: Synthetic oligonucleotide"
ucauccuuggugcugagaagauc

SEQ ID NO: 3970 - RNA, 23 nt, Artificial Sequence
  source: /note="Description of Artificial Sequence: Synthetic oligonucleotide"
ugguaaucucuucauccuuggug

SEQ ID NO: 3971 - RNA, 23 nt, Artificial Sequence
  source: /note="Description of Artificial Sequence: Synthetic oligonucleotide"
uaccucaaaugucuugguaaucu

SEQ ID NO: 3972 - RNA, 23 nt, Artificial Sequence
  source: /note="Description of Artificial Sequence: Synthetic oligonucleotide"
uguugaccucaaaugucuuggua

SEQ ID NO: 3973 - RNA, 23 nt, Artificial Sequence
  source: /note="Description of Artificial Sequence: Synthetic oligonucleotide"
uauguugaccucaaaugucuugg

SEQ ID NO: 3974 - RNA, 23 nt, Artificial Sequence
  source: /note="Description of Artificial Sequence: Synthetic oligonucleotide"
uuaggauguugaccucaaauguc

SEQ ID NO: 3975 - RNA, 23 nt, Artificial Sequence
  source: /note="Description of Artificial Sequence: Synthetic oligonucleotide"
ucuaggauguugaccucaaaugu

SEQ ID NO: 3976 - RNA, 23 nt, Artificial Sequence
  source: /note="Description of Artificial Sequence: Synthetic oligonucleotide"
aaauguccuaggauguugaccuc

SEQ ID NO: 3977 - RNA, 23 nt, Artificial Sequence
  source: /note="Description of Artificial Sequence: Synthetic oligonucleotide"
aaaauguccuaggauguugaccu

SEQ ID NO: 3978 - RNA, 23 nt, Artificial Sequence
  source: /note="Description of Artificial Sequence: Synthetic oligonucleotide"
ugauccaaaaauguccuaggaug

SEQ ID NO: 3979 - RNA, 23 nt, Artificial Sequence
  source: /note="Description of Artificial Sequence: Synthetic oligonucleotide"
agugcuuuugugauccaaaaaug

SEQ ID NO: 3980 - RNA, 23 nt, Artificial Sequence
  source: /note="Description of Artificial Sequence: Synthetic oligonucleotide"
ucaucgauggaagaagugcuuuu

SEQ ID NO: 3981 - RNA, 23 nt, Artificial Sequence
  source: /note="Description of Artificial Sequence: Synthetic oligonucleotide"
aucaucgauggaagaagugcuuu

SEQ ID NO: 3982 - RNA, 23 nt, Artificial Sequence
  source: /note="Description of Artificial Sequence: Synthetic oligonucleotide"
uuggccaugauuucucuccauca

SEQ ID NO: 3983 - RNA, 23 nt, Artificial Sequence
  source: /note="Description of Artificial Sequence: Synthetic oligonucleotide"
auguggccaugauuucucuccau

SEQ ID NO: 3984 - RNA, 23 nt, Artificial Sequence
  source: /note="Description of Artificial Sequence: Synthetic oligonucleotide"
acgauguggccaugauuucucuc

SEQ ID NO: 3985 - RNA, 23 nt, Artificial Sequence
  source: /note="Description of Artificial Sequence: Synthetic oligonucleotide"
uacgauguggccaugauuucucu

SEQ ID NO: 3986 - RNA, 23 nt, Artificial Sequence
  source: /note="Description of Artificial Sequence: Synthetic oligonucleotide"
ugacgauguggccaugauuucuc

SEQ ID NO: 3987 - RNA, 23 nt, Artificial Sequence
  source: /note="Description of Artificial Sequence: Synthetic oligonucleotide"
uugacgauguggccaugauuucu

SEQ ID NO: 3988 - RNA, 23 nt, Artificial Sequence
  source: /note="Description of Artificial Sequence: Synthetic oligonucleotide"
uugaagccacugugacgaugugg

SEQ ID NO: 3989 - RNA, 23 nt, Artificial Sequence
  source: /note="Description of Artificial Sequence: Synthetic oligonucleotide"
acugaagccacugugacgaugug

SEQ ID NO: 3990 - RNA, 23 nt, Artificial Sequence
  source: /note="Description of Artificial Sequence: Synthetic oligonucleotide"
uacugaagccacugugacgaugu

SEQ ID NO: 3991 - RNA, 23 nt, Artificial Sequence
  source: /note="Description of Artificial Sequence: Synthetic oligonucleotide"
acacugaagccacugugacgaug

SEQ ID NO: 3992 - RNA, 23 nt, Artificial Sequence
  source: /note="Description of Artificial Sequence: Synthetic oligonucleotide"
uaaggaaucccuucguggccgca

SEQ ID NO: 3993 - RNA, 23 nt, Artificial Sequence
  source: /note="Description of Artificial Sequence: Synthetic oligonucleotide"
uuaaggaaucccuucguggccgc

SEQ ID NO: 3994 - RNA, 23 nt, Artificial Sequence
  source: /note="Description of Artificial Sequence: Synthetic oligonucleotide"
agguaaggaaucccuucguggcc

SEQ ID NO: 3995 - RNA, 23 nt, Artificial Sequence
  source: /note="Description of Artificial Sequence: Synthetic oligonucleotide"
uagguaaggaaucccuucguggc

SEQ ID NO: 3996 - RNA, 23 nt, Artificial Sequence
  source: /note="Description of Artificial Sequence: Synthetic oligonucleotide"
ugagguaaggaaucccuucgugg

SEQ ID NO: 3997 - RNA, 23 nt, Artificial Sequence
  source: /note="Description of Artificial Sequence: Synthetic oligonucleotide"
uaugagguaaggaaucccuucgu

SEQ ID NO: 3998 - RNA, 23 nt, Artificial Sequence
  source: /note="Description of Artificial Sequence: Synthetic oligonucleotide"
ugaugagguaaggaaucccuucg

SEQ ID NO: 3999 - RNA, 23 nt, Artificial Sequence
  source: /note="Description of Artificial Sequence: Synthetic oligonucleotide"
uugcuggaacaauaugggaugag

SEQ ID NO: 4000 - RNA, 23 nt, Artificial Sequence
  source: /note="Description of Artificial Sequence: Synthetic oligonucleotide"
uagcggcaaauuugcuggaacaa

SEQ ID NO: 4001 - RNA, 23 nt, Artificial Sequence
  source: /note="Description of Artificial Sequence: Synthetic oligonucleotide"
ugaaagccaacagcggcaaauuu

SEQ ID NO: 4002 - RNA, 23 nt, Artificial Sequence
  source: /note="Description of Artificial Sequence: Synthetic oligonucleotide"
uugaaagccaacagcggcaaauu

SEQ ID NO: 4003 - RNA, 23 nt, Artificial Sequence
  source: /note="Description of Artificial Sequence: Synthetic oligonucleotide"
ugugaaagccaacagcggcaaau

SEQ ID NO: 4004 - RNA, 23 nt, Artificial Sequence
  source: /note="Description of Artificial Sequence: Synthetic oligonucleotide"
augucagaccucugugaaagcca

SEQ ID NO: 4005 - RNA, 23 nt, Artificial Sequence
  source: /note="Description of Artificial Sequence: Synthetic oligonucleotide"
uucugaugucagaccucugugaa

SEQ ID NO: 4006 - RNA, 23 nt, Artificial Sequence
  source: /note="Description of Artificial Sequence: Synthetic oligonucleotide"
ugaaguucugaugucagaccucu

SEQ ID NO: 4007 - RNA, 23 nt, Artificial Sequence
  source: /note="Description of Artificial Sequence: Synthetic oligonucleotide"
uauaccaguuuuucccaaggccu

SEQ ID NO: 4008 - RNA, 23 nt, Artificial Sequence
  source: /note="Description of Artificial Sequence: Synthetic oligonucleotide"
acaugagguuuugauaccaguuu

SEQ ID NO: 4009 - RNA, 23 nt, Artificial Sequence
  source: /note="Description of Artificial Sequence: Synthetic oligonucleotide"
uacaugagguuuugauaccaguu

SEQ ID NO: 4010 - RNA, 23 nt, Artificial Sequence
  source: /note="Description of Artificial Sequence: Synthetic oligonucleotide"
ugugaacccaguauucacaaaaa

SEQ ID NO: 4011 - RNA, 23 nt, Artificial Sequence
  source: /note="Description of Artificial Sequence: Synthetic oligonucleotide"
uggugaacccaguauucacaaaa

SEQ ID NO: 4012 - RNA, 23 nt, Artificial Sequence
  source: /note="Description of Artificial Sequence: Synthetic oligonucleotide"
uuggugaacccaguauucacaaa

SEQ ID NO: 4013 - RNA, 23 nt, Artificial Sequence
  source: /note="Description of Artificial Sequence: Synthetic oligonucleotide"
auuuuuggugaacccaguauuca

SEQ ID NO: 4014 - RNA, 23 nt, Artificial Sequence
  source: /note="Description of Artificial Sequence: Synthetic oligonucleotide"
uauuuuuggugaacccaguauuc

SEQ ID NO: 4015 - RNA, 23 nt, Artificial Sequence
  source: /note="Description of Artificial Sequence: Synthetic oligonucleotide"
ugccauaaucuugugcuuggauu

SEQ ID NO: 4016 - RNA, 23 nt, Artificial Sequence
  source: /note="Description of Artificial Sequence: Synthetic oligonucleotide"
uacaggccauaaucuugugcuug

SEQ ID NO: 4017 - RNA, 23 nt, Artificial Sequence
  source: /note="Description of Artificial Sequence: Synthetic oligonucleotide"
auacaggccauaaucuugugcuu

SEQ ID NO: 4018 - RNA, 23 nt, Artificial Sequence
  source: /note="Description of Artificial Sequence: Synthetic oligonucleotide"
aauacaggccauaaucuugugcu

SEQ ID NO: 4019 - RNA, 23 nt, Artificial Sequence
  source: /note="Description of Artificial Sequence: Synthetic oligonucleotide"
ucaauacaggccauaaucuugug

SEQ ID NO: 4020 - RNA, 23 nt, Artificial Sequence
  source: /note="Description of Artificial Sequence: Synthetic oligonucleotide"
uuccaauacaggccauaaucuug

SEQ ID NO: 4021 - RNA, 23 nt, Artificial Sequence
  source: /note="Description of Artificial Sequence: Synthetic oligonucleotide"
uucuccaauacaggccauaaucu

SEQ ID NO: 4022 - RNA, 23 nt, Artificial Sequence
  source: /note="Description of Artificial Sequence: Synthetic oligonucleotide"
ugucuccaauacaggccauaauc

SEQ ID NO: 4023 - RNA, 23 nt, Artificial Sequence
  source: /note="Description of Artificial Sequence: Synthetic oligonucleotide"
aucugucuccaauacaggccaua

SEQ ID NO: 4024 - RNA, 23 nt, Artificial Sequence
  source: /note="Description of Artificial Sequence: Synthetic oligonucleotide"
uaucugucuccaauacaggccau

SEQ ID NO: 4025 - RNA, 23 nt, Artificial Sequence
  source: /note="Description of Artificial Sequence: Synthetic oligonucleotide"
uacgacuucaucugucuccaaua

SEQ ID NO: 4026 - RNA, 23 nt, Artificial Sequence
  source: /note="Description of Artificial Sequence: Synthetic oligonucleotide"
acuucuuacgacuucaucugucu

SEQ ID NO: 4027 - RNA, 23 nt, Artificial Sequence
  source: /note="Description of Artificial Sequence: Synthetic oligonucleotide"
uacuucuuacgacuucaucuguc

SEQ ID NO: 4028 - RNA, 23 nt, Artificial Sequence
  source: /note="Description of Artificial Sequence: Synthetic oligonucleotide"
agacuucuuacgacuucaucugu

SEQ ID NO: 4029 - RNA, 23 nt, Artificial Sequence
  source: /note="Description of Artificial Sequence: Synthetic oligonucleotide"
uagacuucuuacgacuucaucug

SEQ ID NO: 4030 - RNA, 23 nt, Artificial Sequence
  source: /note="Description of Artificial Sequence: Synthetic oligonucleotide"
uaucagacuucuuacgacuucau

SEQ ID NO: 4031 - RNA, 23 nt, Artificial Sequence
  source: /note="Description of Artificial Sequence: Synthetic oligonucleotide"
ucuaucagacuucuuacgacuuc

SEQ ID NO: 4032 - RNA, 23 nt, Artificial Sequence
  source: /note="Description of Artificial Sequence: Synthetic oligonucleotide"
uuccaucuaucagacuucuuacg

SEQ ID NO: 4033 - RNA, 23 nt, Artificial Sequence
  source: /note="Description of Artificial Sequence: Synthetic oligonucleotide"
auuccaucuaucagacuucuuac

SEQ ID NO: 4034 - RNA, 23 nt, Artificial Sequence
  source: /note="Description of Artificial Sequence: Synthetic oligonucleotide"
uuauuccaucuaucagacuucuu

SEQ ID NO: 4035 - RNA, 23 nt, Artificial Sequence
  source: /note="Description of Artificial Sequence: Synthetic oligonucleotide"
aguauuccaucuaucagacuucu

SEQ ID NO: 4036 - RNA, 23 nt, Artificial Sequence
  source: /note="Description of Artificial Sequence: Synthetic oligonucleotide"
uucuuauugguaaguauuccauc

SEQ ID NO: 4037 - RNA, 23 nt, Artificial Sequence
  source: /note="Description of Artificial Sequence: Synthetic oligonucleotide"
uacgauggaacaaaaaucauuuu

SEQ ID NO: 4038 - RNA, 23 nt, Artificial Sequence
  source: /note="Description of Artificial Sequence: Synthetic oligonucleotide"
auacgauggaacaaaaaucauuu

SEQ ID NO: 4039 - RNA, 23 nt, Artificial Sequence
  source: /note="Description of Artificial Sequence: Synthetic oligonucleotide"
uauauacgauggaacaaaaauca

SEQ ID NO: 4040 - RNA, 23 nt, Artificial Sequence
  source: /note="Description of Artificial Sequence: Synthetic oligonucleotide"
uauugauauacgauggaacaaaa

SEQ ID NO: 4041 - RNA, 23 nt, Artificial Sequence
  source: /note="Description of Artificial Sequence: Synthetic oligonucleotide"
uauauugauauacgauggaacaa

SEQ ID NO: 4042 - RNA, 23 nt, Artificial Sequence
  source: /note="Description of Artificial Sequence: Synthetic oligonucleotide"
agauauugauauacgauggaaca

SEQ ID NO: 4043 - RNA, 23 nt, Artificial Sequence
  source: /note="Description of Artificial Sequence: Synthetic oligonucleotide"
aagauauugauauacgauggaac

SEQ ID NO: 4044 - RNA, 23 nt, Artificial Sequence
  source: /note="Description of Artificial Sequence: Synthetic oligonucleotide"
aaagauauugauauacgauggaa

SEQ ID NO: 4045 - RNA, 23 nt, Artificial Sequence
  source: /note="Description of Artificial Sequence: Synthetic oligonucleotide"
uguucaggaagaaacuucuguag

SEQ ID NO: 4046 - RNA, 23 nt, Artificial Sequence
  source: /note="Description of Artificial Sequence: Synthetic oligonucleotide"
ugcguucaggaagaaacuucugu

SEQ ID NO: 4047 - RNA, 23 nt, Artificial Sequence
  source: /note="Description of Artificial Sequence: Synthetic oligonucleotide"
ugcgcguucaggaagaaacuucu

SEQ ID NO: 4048 - RNA, 23 nt, Artificial Sequence
  source: /note="Description of Artificial Sequence: Synthetic oligonucleotide"
uaggcgcguucaggaagaaacuu

SEQ ID NO: 4049 - RNA, 23 nt, Artificial Sequence
  source: /note="Description of Artificial Sequence: Synthetic oligonucleotide"
ucugaggcgcguucaggaagaaa

SEQ ID NO: 4050 - RNA, 23 nt, Artificial Sequence
  source: /note="Description of Artificial Sequence: Synthetic oligonucleotide"
uacgauuuaaaaucgcugaggcg

SEQ ID NO: 4051 - RNA, 23 nt, Artificial Sequence
  source: /note="Description of Artificial Sequence: Synthetic oligonucleotide"
auacgauuuaaaaucgcugaggc

SEQ ID NO: 4052 - RNA, 23 nt, Artificial Sequence
  source: /note="Description of Artificial Sequence: Synthetic oligonucleotide"
uauacgauuuaaaaucgcugagg

SEQ ID NO: 4053 - RNA, 23 nt, Artificial Sequence
  source: /note="Description of Artificial Sequence: Synthetic oligonucleotide"
ucauacgauuuaaaaucgcugag

SEQ ID NO: 4054 - RNA, 23 nt, Artificial Sequence
  source: /note="Description of Artificial Sequence: Synthetic oligonucleotide"
ugcauacgauuuaaaaucgcuga

SEQ ID NO: 4055 - RNA, 23 nt, Artificial Sequence
  source: /note="Description of Artificial Sequence: Synthetic oligonucleotide"
uugcauacgauuuaaaaucgcug

SEQ ID NO: 4056 - RNA, 23 nt, Artificial Sequence
  source: /note="Description of Artificial Sequence: Synthetic oligonucleotide"
ucugcauacgauuuaaaaucgcu

SEQ ID NO: 4057 - RNA, 23 nt, Artificial Sequence
  source: /note="Description of Artificial Sequence: Synthetic oligonucleotide"
uucugcauacgauuuaaaaucgc

SEQ ID NO: 4058 - RNA, 23 nt, Artificial Sequence
  source: /note="Description of Artificial Sequence: Synthetic oligonucleotide"
auucugcauacgauuuaaaaucg

SEQ ID NO: 4059 - RNA, 23 nt, Artificial Sequence
  source: /note="Description of Artificial Sequence: Synthetic oligonucleotide"
uauucugcauacgauuuaaaauc

SEQ ID NO: 4060 - RNA, 23 nt, Artificial Sequence
  source: /note="Description of Artificial Sequence: Synthetic oligonucleotide"
ugaauauucugcauacgauuuaa

SEQ ID NO: 4061 - RNA, 23 nt, Artificial Sequence
  source: /note="Description of Artificial Sequence: Synthetic oligonucleotide"
auugaauauucugcauacgauuu

SEQ ID NO: 4062 - RNA, 23 nt, Artificial Sequence
  source: /note="Description of Artificial Sequence: Synthetic oligonucleotide"
accacugcuucaaauugaauauu

SEQ ID NO: 4063 - RNA, 23 nt, Artificial Sequence
  source: /note="Description of Artificial Sequence: Synthetic oligonucleotide"
uuggcuggagcuuauuuauucau

SEQ ID NO: 4064 - RNA, 23 nt, Artificial Sequence
  source: /note="Description of Artificial Sequence: Synthetic oligonucleotide"
ucuggcuggagcuuauuuauuca

SEQ ID NO: 4065 - RNA, 23 nt, Artificial Sequence
  source: /note="Description of Artificial Sequence: Synthetic oligonucleotide"
aucaugcauacaucucuggcugg

SEQ ID NO: 4066 - RNA, 23 nt, Artificial Sequence
  source: /note="Description of Artificial Sequence: Synthetic oligonucleotide"
uaucaugcauacaucucuggcug

SEQ ID NO: 4067 - RNA, 23 nt, Artificial Sequence
  source: /note="Description of Artificial Sequence: Synthetic oligonucleotide"
uugauucgaaacuauucauauca

SEQ ID NO: 4068 - RNA, 23 nt, Artificial Sequence
  source: /note="Description of Artificial Sequence: Synthetic oligonucleotide"
auugauucgaaacuauucauauc

SEQ ID NO: 4069 - RNA, 23 nt, Artificial Sequence
  source: /note="Description of Artificial Sequence: Synthetic oligonucleotide"
uagcauugauucgaaacuauuca

SEQ ID NO: 4070 - RNA, 23 nt, Artificial Sequence
  source: /note="Description of Artificial Sequence: Synthetic oligonucleotide"
uuuaauauuaucaggacugaaaa

SEQ ID NO: 4071 - RNA, 23 nt, Artificial Sequence
  source: /note="Description of Artificial Sequence: Synthetic oligonucleotide"
uagugccaaaccaauguuuuuaa

SEQ ID NO: 4072 - RNA, 23 nt, Artificial Sequence
  source: /note="Description of Artificial Sequence: Synthetic oligonucleotide"
uuagugccaaaccaauguuuuua

SEQ ID NO: 4073 - RNA, 23 nt, Artificial Sequence
  source: /note="Description of Artificial Sequence: Synthetic oligonucleotide"
aauuaaucuuguucguuugacug

SEQ ID NO: 4074 - RNA, 23 nt, Artificial Sequence
  source: /note="Description of Artificial Sequence: Synthetic oligonucleotide"
uguaauuaaucuuguucguuuga

SEQ ID NO: 4075 - RNA, 23 nt, Artificial Sequence
  source: /note="Description of Artificial Sequence: Synthetic oligonucleotide"
agguaauuaaucuuguucguuug

SEQ ID NO: 4076 - RNA, 23 nt, Artificial Sequence
  source: /note="Description of Artificial Sequence: Synthetic oligonucleotide"
uagguaauuaaucuuguucguuu

SEQ ID NO: 4077 - RNA, 23 nt, Artificial Sequence
  source: /note="Description of Artificial Sequence: Synthetic oligonucleotide"
acagguaauuaaucuuguucguu

SEQ ID NO: 4078 - RNA, 23 nt, Artificial Sequence
  source: /note="Description of Artificial Sequence: Synthetic oligonucleotide"
acuacguaaauauucuugagaaa

SEQ ID NO: 4079 - RNA, 23 nt, Artificial Sequence
  source: /note="Description of Artificial Sequence: Synthetic oligonucleotide"
aaacuacguaaauauucuugaga

SEQ ID NO: 4080 - RNA, 23 nt, Artificial Sequence
  source: /note="Description of Artificial Sequence: Synthetic oligonucleotide"
aaaacuacguaaauauucuugag

SEQ ID NO: 4081 - RNA, 23 nt, Artificial Sequence
  source: /note="Description of Artificial Sequence: Synthetic oligonucleotide"
aggaaaaacagaccuaugaaaaa

SEQ ID NO: 4082 - RNA, 23 nt, Artificial Sequence
  source: /note="Description of Artificial Sequence: Synthetic oligonucleotide"
uaaguuuuuaagaggcaugaaag

SEQ ID NO: 4083 - RNA, 23 nt, Artificial Sequence
  source: /note="Description of Artificial Sequence: Synthetic oligonucleotide"
uauguaagcacagaaguuuuuaa

SEQ ID NO: 4084 - RNA, 23 nt, Artificial Sequence
  source: /note="Description of Artificial Sequence: Synthetic oligonucleotide"
uuauguaagcacagaaguuuuua

SEQ ID NO: 4085 - RNA, 23 nt, Artificial Sequence
  source: /note="Description of Artificial Sequence: Synthetic oligonucleotide"
uuuauguaagcacagaaguuuuu

SEQ ID NO: 4086 - RNA, 23 nt, Artificial Sequence
  source: /note="Description of Artificial Sequence: Synthetic oligonucleotide"
uuccaccuuuaaauggaaaaaua

SEQ ID NO: 4087 - RNA, 23 nt, Artificial Sequence
  source: /note="Description of Artificial Sequence: Synthetic oligonucleotide"
uauuuacuuuuagggagguagcu

SEQ ID NO: 4088 - RNA, 23 nt, Artificial Sequence
  source: /note="Description of Artificial Sequence: Synthetic oligonucleotide"
uuauuuacuuuuagggagguagc

SEQ ID NO: 4089 - RNA, 23 nt, Artificial Sequence
  source: /note="Description of Artificial Sequence: Synthetic oligonucleotide"
uguaaauaaguucucuuuguauu

SEQ ID NO: 4090 - RNA, 23 nt, Artificial Sequence
  source: /note="Description of Artificial Sequence: Synthetic oligonucleotide"
ucuucccuguguaaauaaguucu

SEQ ID NO: 4091 - RNA, 23 nt, Artificial Sequence
  source: /note="Description of Artificial Sequence: Synthetic oligonucleotide"
ucuuaaaccuucccuguguaaau

SEQ ID NO: 4092 - RNA, 23 nt, Artificial Sequence
  source: /note="Description of Artificial Sequence: Synthetic oligonucleotide"
uucuuaaaccuucccuguguaaa

SEQ ID NO: 4093 - RNA, 23 nt, Artificial Sequence
  source: /note="Description of Artificial Sequence: Synthetic oligonucleotide"
agucuuaaaccuucccuguguaa

SEQ ID NO: 4094 - RNA, 23 nt, Artificial Sequence
  source: /note="Description of Artificial Sequence: Synthetic oligonucleotide"
uacuugaacagucuuaaaccuuc

SEQ ID NO: 4095 - RNA, 23 nt, Artificial Sequence
  source: /note="Description of Artificial Sequence: Synthetic oligonucleotide"
ugcuacuugaacagucuuaaacc

SEQ ID NO: 4096 - RNA, 23 nt, Artificial Sequence
  source: /note="Description of Artificial Sequence: Synthetic oligonucleotide"
aaugcuacuugaacagucuuaaa

SEQ ID NO: 4097 - RNA, 23 nt, Artificial Sequence
  source: /note="Description of Artificial Sequence: Synthetic oligonucleotide"
ugaaugcuacuugaacagucuua

SEQ ID NO: 4098 - RNA, 23 nt, Artificial Sequence
  source: /note="Description of Artificial Sequence: Synthetic oligonucleotide"
auuggaaugcuacuugaacaguc

SEQ ID NO: 4099 - RNA, 23 nt, Artificial Sequence
  source: /note="Description of Artificial Sequence: Synthetic oligonucleotide"
agauuggaaugcuacuugaacag

SEQ ID NO: 4100 - RNA, 23 nt, Artificial Sequence
  source: /note="Description of Artificial Sequence: Synthetic oligonucleotide"
uagauuggaaugcuacuugaaca

SEQ ID NO: 4101 - RNA, 23 nt, Artificial Sequence
  source: /note="Description of Artificial Sequence: Synthetic oligonucleotide"
uggcuacagauuggaaugcuacu

SEQ ID NO: 4102 - RNA, 23 nt, Artificial Sequence
  source: /note="Description of Artificial Sequence: Synthetic oligonucleotide"
auggcuacagauuggaaugcuac

SEQ ID NO: 4103 - RNA, 23 nt, Artificial Sequence
  source: /note="Description of Artificial Sequence: Synthetic oligonucleotide"
uauggcuacagauuggaaugcua

SEQ ID NO: 4104 - RNA, 23 nt, Artificial Sequence
  source: /note="Description of Artificial Sequence: Synthetic oligonucleotide"
uuugauauucuguggcauggcua

SEQ ID NO: 4105 - RNA, 23 nt, Artificial Sequence
  source: /note="Description of Artificial Sequence: Synthetic oligonucleotide"
uguugauauucuguggcauggcu

SEQ ID NO: 4106 - RNA, 23 nt, Artificial Sequence
  source: /note="Description of Artificial Sequence: Synthetic oligonucleotide"
uugcacucauucuguguucuugu

SEQ ID NO: 4107 - RNA, 23 nt, Artificial Sequence
  source: /note="Description of Artificial Sequence: Synthetic oligonucleotide"
uauaaagcugccugcugaaacuu

SEQ ID NO: 4108 - RNA, 23 nt, Artificial Sequence
  source: /note="Description of Artificial Sequence: Synthetic oligonucleotide"
agauaaagcugccugcugaaacu

SEQ ID NO: 4109 - RNA, 23 nt, Artificial Sequence
  source: /note="Description of Artificial Sequence: Synthetic oligonucleotide"
uccagguugagauaaagcugccu

SEQ ID NO: 4110 - RNA, 23 nt, Artificial Sequence
  source: /note="Description of Artificial Sequence: Synthetic oligonucleotide"
aaaauauguccagguugagauaa

SEQ ID NO: 4111 - RNA, 23 nt, Artificial Sequence
  source: /note="Description of Artificial Sequence: Synthetic oligonucleotide"
ugcuagggaaaucuuucaaaugc

SEQ ID NO: 4112 - RNA, 23 nt, Artificial Sequence
  source: /note="Description of Artificial Sequence: Synthetic oligonucleotide"
uaggcuagggaaaucuuucaaau

SEQ ID NO: 4113 - RNA, 23 nt, Artificial Sequence
  source: /note="Description of Artificial Sequence: Synthetic oligonucleotide"
agaggcuagggaaaucuuucaaa

SEQ ID NO: 4114 - RNA, 23 nt, Artificial Sequence
  source: /note="Description of Artificial Sequence: Synthetic oligonucleotide"
aagaggcuagggaaaucuuucaa

SEQ ID NO: 4115 - RNA, 23 nt, Artificial Sequence
  source: /note="Description of Artificial Sequence: Synthetic oligonucleotide"
uugcaccguuuugggcuaaugaa

SEQ ID NO: 4116 - RNA, 23 nt, Artificial Sequence
  source: /note="Description of Artificial Sequence: Synthetic oligonucleotide"
uuugcaccguuuugggcuaauga

SEQ ID NO: 4117 - RNA, 23 nt, Artificial Sequence
  source: /note="Description of Artificial Sequence: Synthetic oligonucleotide"
aguugcaccguuuugggcuaaug

SEQ ID NO: 4118 - RNA, 23 nt, Artificial Sequence
  source: /note="Description of Artificial Sequence: Synthetic oligonucleotide"
uaguugcaccguuuugggcuaau

SEQ ID NO: 4119 - RNA, 23 nt, Artificial Sequence
  source: /note="Description of Artificial Sequence: Synthetic oligonucleotide"
agaguugcaccguuuugggcuaa

SEQ ID NO: 4120 - RNA, 23 nt, Artificial Sequence
  source: /note="Description of Artificial Sequence: Synthetic oligonucleotide"
uagaguugcaccguuuugggcua

SEQ ID NO: 4121 - RNA, 23 nt, Artificial Sequence
  source: /note="Description of Artificial Sequence: Synthetic oligonucleotide"
aauagaguugcaccguuuugggc

SEQ ID NO: 4122 - RNA, 23 nt, Artificial Sequence
  source: /note="Description of Artificial Sequence: Synthetic oligonucleotide"
agaauagaguugcaccguuuugg

SEQ ID NO: 4123 - RNA, 23 nt, Artificial Sequence
  source: /note="Description of Artificial Sequence: Synthetic oligonucleotide"
uagaauagaguugcaccguuuug

SEQ ID NO: 4124 - RNA, 23 nt, Artificial Sequence
  source: /note="Description of Artificial Sequence: Synthetic oligonucleotide"
ucagaauagaguugcaccguuuu

SEQ ID NO: 4125 - RNA, 23 nt, Artificial Sequence
  source: /note="Description of Artificial Sequence: Synthetic oligonucleotide"
aguccagaauagaguugcaccgu

SEQ ID NO: 4126 - RNA, 23 nt, Artificial Sequence
  source: /note="Description of Artificial Sequence: Synthetic oligonucleotide"
aaaguccagaauagaguugcacc

SEQ ID NO: 4127 - RNA, 23 nt, Artificial Sequence
  source: /note="Description of Artificial Sequence: Synthetic oligonucleotide"
auaaaguccagaauagaguugca

SEQ ID NO: 4128 - RNA, 23 nt, Artificial Sequence
  source: /note="Description of Artificial Sequence: Synthetic oligonucleotide"
aauaaaguccagaauagaguugc

SEQ ID NO: 4129 - RNA, 23 nt, Artificial Sequence
  source: /note="Description of Artificial Sequence: Synthetic oligonucleotide"
ucaaguaauaaaguccagaauag

SEQ ID NO: 4130 - RNA, 23 nt, Artificial Sequence
  source: /note="Description of Artificial Sequence: Synthetic oligonucleotide"
uguggacuucagaguuauacaga

SEQ ID NO: 4131 - RNA, 23 nt, Artificial Sequence
  source: /note="Description of Artificial Sequence: Synthetic oligonucleotide"
ugguggacuucagaguuauacag

SEQ ID NO: 4132 - RNA, 23 nt, Artificial Sequence
  source: /note="Description of Artificial Sequence: Synthetic oligonucleotide"
uguccacuuuugguggacuucag

SEQ ID NO: 4133 - RNA, 23 nt, Artificial Sequence
  source: /note="Description of Artificial Sequence: Synthetic oligonucleotide"
uaggguccacuuuugguggacuu

SEQ ID NO: 4134 - RNA, 23 nt, Artificial Sequence
  source: /note="Description of Artificial Sequence: Synthetic oligonucleotide"
auagaggguccacuuuuggugga

SEQ ID NO: 4135 - RNA, 23 nt, Artificial Sequence
  source: /note="Description of Artificial Sequence: Synthetic oligonucleotide"
uauagaggguccacuuuuggugg

SEQ ID NO: 4136 - RNA, 23 nt, Artificial Sequence
  source: /note="Description of Artificial Sequence: Synthetic oligonucleotide"
auauagaggguccacuuuuggug

SEQ ID NO: 4137 - RNA, 23 nt, Artificial Sequence
  source: /note="Description of Artificial Sequence: Synthetic oligonucleotide"
aaauauagaggguccacuuuugg

SEQ ID NO: 4138 - RNA, 23 nt, Artificial Sequence
  source: /note="Description of Artificial Sequence: Synthetic oligonucleotide"
uaaauauagaggguccacuuuug

SEQ ID NO: 4139 - RNA, 23 nt, Artificial Sequence
  source: /note="Description of Artificial Sequence: Synthetic oligonucleotide"
ugaaauauagaggguccacuuuu

SEQ ID NO: 4140 - RNA, 23 nt, Artificial Sequence
  source: /note="Description of Artificial Sequence: Synthetic oligonucleotide"
uggucaccuuucauaauguaucu

SEQ ID NO: 4141 - RNA, 23 nt, Artificial Sequence
  source: /note="Description of Artificial Sequence: Synthetic oligonucleotide"
ucggucaccuuucauaauguauc

SEQ ID NO: 4142 - RNA, 23 nt, Artificial Sequence
  source: /note="Description of Artificial Sequence: Synthetic oligonucleotide"
uucggucaccuuucauaauguau

SEQ ID NO: 4143 - RNA, 23 nt, Artificial Sequence
  source: /note="Description of Artificial Sequence: Synthetic oligonucleotide"
agucggucaccuuucauaaugua

SEQ ID NO: 4144 - RNA, 23 nt, Artificial Sequence
  source: /note="Description of Artificial Sequence: Synthetic oligonucleotide"
uagucggucaccuuucauaaugu

SEQ ID NO: 4145 - RNA, 23 nt, Artificial Sequence
  source: /note="Description of Artificial Sequence: Synthetic oligonucleotide"
uuaaaauagagucggucaccuuu

SEQ ID NO: 4146 - RNA, 23 nt, Artificial Sequence
  source: /note="Description of Artificial Sequence: Synthetic oligonucleotide"
uagaacuuaaaauucugagauuu

SEQ ID NO: 4147 - RNA, 23 nt, Artificial Sequence
  source: /note="Description of Artificial Sequence: Synthetic oligonucleotide"
uggaccaaggauauaugaaagca

SEQ ID NO: 4148 - RNA, 23 nt, Artificial Sequence
  source: /note="Description of Artificial Sequence: Synthetic oligonucleotide"
ugggaccaaggauauaugaaagc

SEQ ID NO: 4149 - RNA, 23 nt, Artificial Sequence
  source: /note="Description of Artificial Sequence: Synthetic oligonucleotide"
uugggaccaaggauauaugaaag

SEQ ID NO: 4150 - RNA, 23 nt, Artificial Sequence
  source: /note="Description of Artificial Sequence: Synthetic oligonucleotide"
uugucuaaacaucucugggacca

SEQ ID NO: 4151 - RNA, 23 nt, Artificial Sequence
  source: /note="Description of Artificial Sequence: Synthetic oligonucleotide"
aaaauugucuaaacaucucuggg

SEQ ID NO: 4152 - RNA, 23 nt, Artificial Sequence
  source: /note="Description of Artificial Sequence: Synthetic oligonucleotide"
uaaaauugucuaaacaucucugg

SEQ ID NO: 4153 - RNA, 23 nt, Artificial Sequence
  source: /note="Description of Artificial Sequence: Synthetic oligonucleotide"
ugagccuaaaauugucuaaacau

SEQ ID NO: 4154 - RNA, 23 nt, Artificial Sequence
  source: /note="Description of Artificial Sequence: Synthetic oligonucleotide"
uugagccuaaaauugucuaaaca

SEQ ID NO: 4155 - RNA, 23 nt, Artificial Sequence
  source: /note="Description of Artificial Sequence: Synthetic oligonucleotide"
uuugagccuaaaauugucuaaac

SEQ ID NO: 4156 - RNA, 23 nt, Artificial Sequence
  source: /note="Description of Artificial Sequence: Synthetic oligonucleotide"
uuuugagccuaaaauugucuaaa

SEQ ID NO: 4157 - RNA, 23 nt, Artificial Sequence
  source: /note="Description of Artificial Sequence: Synthetic oligonucleotide"
uuuuugagccuaaaauugucuaa

SEQ ID NO: 4158 - RNA, 23 nt, Artificial Sequence
  source: /note="Description of Artificial Sequence: Synthetic oligonucleotide"
aauuuuugagccuaaaauugucu

SEQ ID NO: 4159 - RNA, 23 nt, Artificial Sequence
  source: /note="Description of Artificial Sequence: Synthetic oligonucleotide"
ucuuuaauuuuugagccuaaaau

SEQ ID NO: 4160 - RNA, 23 nt, Artificial Sequence
  source: /note="Description of Artificial Sequence: Synthetic oligonucleotide"
agcuuuaauuuuugagccuaaaa

SEQ ID NO: 4161 - RNA, 23 nt, Artificial Sequence
  source: /note="Description of Artificial Sequence: Synthetic oligonucleotide"
uagcuuuaauuuuugagccuaaa

SEQ ID NO: 4162 - RNA, 23 nt, Artificial Sequence
  source: /note="Description of Artificial Sequence: Synthetic oligonucleotide"
ucaguacaguuccuuuuccugug

SEQ ID NO: 4163 - RNA, 23 nt, Artificial Sequence
  source: /note="Description of Artificial Sequence: Synthetic oligonucleotide"
agccaguacaguuccuuuuccug

SEQ ID NO: 4164 - RNA, 23 nt, Artificial Sequence
  source: /note="Description of Artificial Sequence: Synthetic oligonucleotide"
auagccaguacaguuccuuuucc

SEQ ID NO: 4165 - RNA, 23 nt, Artificial Sequence
  source: /note="Description of Artificial Sequence: Synthetic oligonucleotide"
uuaauagccaguacaguuccuuu

SEQ ID NO: 4166 - RNA, 23 nt, Artificial Sequence
  source: /note="Description of Artificial Sequence: Synthetic oligonucleotide"
uguaauagccaguacaguuccuu

SEQ ID NO: 4167 - RNA, 23 nt, Artificial Sequence
  source: /note="Description of Artificial Sequence: Synthetic oligonucleotide"
uauguagugggagucggauuauu

SEQ ID NO: 4168 - RNA, 23 nt, Artificial Sequence
  source: /note="Description of Artificial Sequence: Synthetic oligonucleotide"
uuugauguagugggagucggauu

SEQ ID NO: 4169 - RNA, 23 nt, Artificial Sequence
  source: /note="Description of Artificial Sequence: Synthetic oligonucleotide"
uuagucuugauguagugggaguc

SEQ ID NO: 4170 - RNA, 23 nt, Artificial Sequence
  source: /note="Description of Artificial Sequence: Synthetic oligonucleotide"
auuagucuugauguagugggagu

SEQ ID NO: 4171 - RNA, 23 nt, Artificial Sequence
  source: /note="Description of Artificial Sequence: Synthetic oligonucleotide"
uauuagucuugauguagugggag

SEQ ID NO: 4172 - RNA, 23 nt, Artificial Sequence
  source: /note="Description of Artificial Sequence: Synthetic oligonucleotide"
agauuagucuugauguaguggga

SEQ ID NO: 4173 - RNA, 23 nt, Artificial Sequence
  source: /note="Description of Artificial Sequence: Synthetic oligonucleotide"
uaagauuagucuugauguagugg

SEQ ID NO: 4174 - RNA, 23 nt, Artificial Sequence
  source: /note="Description of Artificial Sequence: Synthetic oligonucleotide"
acaagauuagucuugauguagug

SEQ ID NO: 4175 - RNA, 23 nt, Artificial Sequence
  source: /note="Description of Artificial Sequence: Synthetic oligonucleotide"
aacaagauuagucuugauguagu

SEQ ID NO: 4176 - RNA, 23 nt, Artificial Sequence
  source: /note="Description of Artificial Sequence: Synthetic oligonucleotide"
aaacaagauuagucuugauguag

SEQ ID NO: 4177 - RNA, 23 nt, Artificial Sequence
  source: /note="Description of Artificial Sequence: Synthetic oligonucleotide"
ugcaaaagcauucuauaauacau

SEQ ID NO: 4178 - RNA, 23 nt, Artificial Sequence
  source: /note="Description of Artificial Sequence: Synthetic oligonucleotide"
uccaugcaaaagcauucuauaau

SEQ ID NO: 4179 - RNA, 23 nt, Artificial Sequence
  source: /note="Description of Artificial Sequence: Synthetic oligonucleotide"
uaguccaugcaaaagcauucuau

SEQ ID NO: 4180 - RNA, 23 nt, Artificial Sequence
  source: /note="Description of Artificial Sequence: Synthetic oligonucleotide"
auaguccaugcaaaagcauucua

SEQ ID NO: 4181 - RNA, 23 nt, Artificial Sequence
  source: /note="Description of Artificial Sequence: Synthetic oligonucleotide"
aggauaguccaugcaaaagcauu

SEQ ID NO: 4182 - RNA, 23 nt, Artificial Sequence
  source: /note="Description of Artificial Sequence: Synthetic oligonucleotide"
agaggauaguccaugcaaaagca

SEQ ID NO: 4183 - RNA, 23 nt, Artificial Sequence
  source: /note="Description of Artificial Sequence: Synthetic oligonucleotide"
aacaagaggauaguccaugcaaa

SEQ ID NO: 4184 - RNA, 23 nt, Artificial Sequence
  source: /note="Description of Artificial Sequence: Synthetic oligonucleotide"
aaacaagaggauaguccaugcaa

SEQ ID NO: 4185 - RNA, 23 nt, Artificial Sequence
  source: /note="Description of Artificial Sequence: Synthetic oligonucleotide"
uauaacuacaagagguuauuuuu

SEQ ID NO: 4186 - RNA, 23 nt, Artificial Sequence
  source: /note="Description of Artificial Sequence: Synthetic oligonucleotide"
auuuuauaacuacaagagguuau

SEQ ID NO: 4187 - RNA, 23 nt, Artificial Sequence
  source: /note="Description of Artificial Sequence: Synthetic oligonucleotide"
gacaguaccuccucccuaggacu

SEQ ID NO: 4188 - RNA, 23 nt, Artificial Sequence
  source: /note="Description of Artificial Sequence: Synthetic oligonucleotide"
acaguaccuccucccuaggacua

SEQ ID NO: 4189 - RNA, 23 nt, Artificial Sequence
  source: /note="Description of Artificial Sequence: Synthetic oligonucleotide"
caguaccuccucccuaggacuac

SEQ ID NO: 4190 - RNA, 23 nt, Artificial Sequence
  source: /note="Description of Artificial Sequence: Synthetic oligonucleotide"
ggacuacacaaggacugaaccag

SEQ ID NO: 4191 - RNA, 23 nt, Artificial Sequence
  source: /note="Description of Artificial Sequence: Synthetic oligonucleotide"
gacuacacaaggacugaaccaga

SEQ ID NO: 4192 - RNA, 23 nt, Artificial Sequence
  source: /note="Description of Artificial Sequence: Synthetic oligonucleotide"
cuacacaaggacugaaccagaag

SEQ ID NO: 4193 - RNA, 23 nt, Artificial Sequence
  source: /note="Description of Artificial Sequence: Synthetic oligonucleotide"
gacagagcaaagccaugaacauc

SEQ ID NO: 4194 - RNA, 23 nt, Artificial Sequence
  source: /note="Description of Artificial Sequence: Synthetic oligonucleotide"
caucauccuagaaauccuucugc

SEQ ID NO: 4195 - RNA, 23 nt, Artificial Sequence
  source: /note="Description of Artificial Sequence: Synthetic oligonucleotide"
aauccuucugcuucugaucacca

SEQ ID NO: 4196 - RNA, 23 nt, Artificial Sequence
  source: /note="Description of Artificial Sequence: Synthetic oligonucleotide"
caccaucaucuacuccuacuugg

SEQ ID NO: 4197 - RNA, 23 nt, Artificial Sequence
  source: /note="Description of Artificial Sequence: Synthetic oligonucleotide"
caucuacuccuacuuggagucgu

SEQ ID NO: 4198 - RNA, 23 nt, Artificial Sequence
  source: /note="Description of Artificial Sequence: Synthetic oligonucleotide"
aucuacuccuacuuggagucguu

SEQ ID NO: 4199 - RNA, 23 nt, Artificial Sequence
  source: /note="Description of Artificial Sequence: Synthetic oligonucleotide"
ucuacuccuacuuggagucguug

SEQ ID NO: 4200 - RNA, 23 nt, Artificial Sequence
  source: /note="Description of Artificial Sequence: Synthetic oligonucleotide"
cuacuccuacuuggagucguugg

SEQ ID NO: 4201 - RNA, 23 nt, Artificial Sequence
  source: /note="Description of Artificial Sequence: Synthetic oligonucleotide"
uacuccuacuuggagucguuggu

SEQ ID NO: 4202 - RNA, 23 nt, Artificial Sequence
  source: /note="Description of Artificial Sequence: Synthetic oligonucleotide"
acuccuacuuggagucguuggug

SEQ ID NO: 4203 - RNA, 23 nt, Artificial Sequence
  source: /note="Description of Artificial Sequence: Synthetic oligonucleotide"
gagucguuggugaaguuuuucau

SEQ ID NO: 4204 - RNA, 23 nt, Artificial Sequence
  source: /note="Description of Artificial Sequence: Synthetic oligonucleotide"
gggagauuguucucauuacugga

SEQ ID NO: 4205 - RNA, 23 nt, Artificial Sequence
  source: /note="Description of Artificial Sequence: Synthetic oligonucleotide"
gauuguucucauuacuggagcug

SEQ ID NO: 4206 - RNA, 23 nt, Artificial Sequence
  source: /note="Description of Artificial Sequence: Synthetic oligonucleotide"
aggcagacuacuuaugaauuugc

SEQ ID NO: 4207 - RNA, 23 nt, Artificial Sequence
  source: /note="Description of Artificial Sequence: Synthetic oligonucleotide"
cuacuuaugaauuugcaaaacga

SEQ ID NO: 4208 - RNA, 23 nt, Artificial Sequence
  source: /note="Description of Artificial Sequence: Synthetic oligonucleotide"
gaauuugcaaaacgacagagcau

SEQ ID NO: 4209 - RNA, 23 nt, Artificial Sequence
  source: /note="Description of Artificial Sequence: Synthetic oligonucleotide"
aauuugcaaaacgacagagcaua

SEQ ID NO: 4210 - RNA, 23 nt, Artificial Sequence
  source: /note="Description of Artificial Sequence: Synthetic oligonucleotide"
gacagagcauauugguucugugg

SEQ ID NO: 4211 - RNA, 23 nt, Artificial Sequence
  source: /note="Description of Artificial Sequence: Synthetic oligonucleotide"
acagagcauauugguucuguggg

SEQ ID NO: 4212 - RNA, 23 nt, Artificial Sequence
  source: /note="Description of Artificial Sequence: Synthetic oligonucleotide"
cagagcauauugguucuguggga

SEQ ID NO: 4213 - RNA, 23 nt, Artificial Sequence
  source: /note="Description of Artificial Sequence: Synthetic oligonucleotide"
uucugugggauauuaauaagcgc

SEQ ID NO: 4214 - RNA, 23 nt, Artificial Sequence
  source: /note="Description of Artificial Sequence: Synthetic oligonucleotide"
auauuaauaagcgcgguguggag

SEQ ID NO: 4215 - RNA, 23 nt, Artificial Sequence
  source: /note="Description of Artificial Sequence: Synthetic oligonucleotide"
uauuaauaagcgcgguguggagg

SEQ ID NO: 4216 - RNA, 23 nt, Artificial Sequence
  source: /note="Description of Artificial Sequence: Synthetic oligonucleotide"
ggaaacugcagcugagugccgaa

SEQ ID NO: 4217 - RNA, 23 nt, Artificial Sequence
  source: /note="Description of Artificial Sequence: Synthetic oligonucleotide"
gaaacugcagcugagugccgaaa

SEQ ID NO: 4218 - RNA, 23 nt, Artificial Sequence
  source: /note="Description of Artificial Sequence: Synthetic oligonucleotide"
aaacugcagcugagugccgaaaa

SEQ ID NO: 4219 - RNA, 23 nt, Artificial Sequence
  source: /note="Description of Artificial Sequence: Synthetic oligonucleotide"
aacugcagcugagugccgaaaac

SEQ ID NO: 4220 - RNA, 23 nt, Artificial Sequence
  source: /note="Description of Artificial Sequence: Synthetic oligonucleotide"
acugcagcugagugccgaaaacu

SEQ ID NO: 4221 - RNA, 23 nt, Artificial Sequence
  source: /note="Description of Artificial Sequence: Synthetic oligonucleotide"
cugcagcugagugccgaaaacua

SEQ ID NO: 4222 - RNA, 23 nt, Artificial Sequence
  source: /note="Description of Artificial Sequence: Synthetic oligonucleotide"
ugcagcugagugccgaaaacuag

SEQ ID NO: 4223 - RNA, 23 nt, Artificial Sequence
  source: /note="Description of Artificial Sequence: Synthetic oligonucleotide"
cagcugagugccgaaaacuaggc

SEQ ID NO: 4224 - RNA, 23 nt, Artificial Sequence
  source: /note="Description of Artificial Sequence: Synthetic oligonucleotide"
agcugagugccgaaaacuaggcg

SEQ ID NO: 4225 - RNA, 23 nt, Artificial Sequence
  source: /note="Description of Artificial Sequence: Synthetic oligonucleotide"
gcugagugccgaaaacuaggcgu

SEQ ID NO: 4226 - RNA, 23 nt, Artificial Sequence
  source: /note="Description of Artificial Sequence: Synthetic oligonucleotide"
cugagugccgaaaacuaggcguc

SEQ ID NO: 4227 - RNA, 23 nt, Artificial Sequence
  source: /note="Description of Artificial Sequence: Synthetic oligonucleotide"
ugagugccgaaaacuaggcguca

SEQ ID NO: 4228 - RNA, 23 nt, Artificial Sequence
  source: /note="Description of Artificial Sequence: Synthetic oligonucleotide"
gagugccgaaaacuaggcgucac

SEQ ID NO: 4229 - RNA, 23 nt, Artificial Sequence
  source: /note="Description of Artificial Sequence: Synthetic oligonucleotide"
agugccgaaaacuaggcgucacu

SEQ ID NO: 4230 - RNA, 23 nt, Artificial Sequence
  source: /note="Description of Artificial Sequence: Synthetic oligonucleotide"
gugccgaaaacuaggcgucacug

SEQ ID NO: 4231 - RNA, 23 nt, Artificial Sequence
  source: /note="Description of Artificial Sequence: Synthetic oligonucleotide"
ugccgaaaacuaggcgucacugc

SEQ ID NO: 4232 - RNA, 23 nt, Artificial Sequence
  source: /note="Description of Artificial Sequence: Synthetic oligonucleotide"
gccgaaaacuaggcgucacugcg

SEQ ID NO: 4233 - RNA, 23 nt, Artificial Sequence
  source: /note="Description of Artificial Sequence: Synthetic oligonucleotide"
cgaaaacuaggcgucacugcgca

SEQ ID NO: 4234 - RNA, 23 nt, Artificial Sequence
  source: /note="Description of Artificial Sequence: Synthetic oligonucleotide"
aaaacuaggcgucacugcgcaug

SEQ ID NO: 4235 - RNA, 23 nt, Artificial Sequence
  source: /note="Description of Artificial Sequence: Synthetic oligonucleotide"
aaacuaggcgucacugcgcaugc

SEQ ID NO: 4236 - RNA, 23 nt, Artificial Sequence
  source: /note="Description of Artificial Sequence: Synthetic oligonucleotide"
uaggcgucacugcgcaugcguau

SEQ ID NO: 4237 - RNA, 23 nt, Artificial Sequence
  source: /note="Description of Artificial Sequence: Synthetic oligonucleotide"
gcgcaugcguaugugguagacug

SEQ ID NO: 4238 - RNA, 23 nt, Artificial Sequence
  source: /note="Description of Artificial Sequence: Synthetic oligonucleotide"
cgcaugcguaugugguagacugc

SEQ ID NO: 4239 - RNA, 23 nt, Artificial Sequence
  source: /note="Description of Artificial Sequence: Synthetic oligonucleotide"
gcaacagagaagagaucuaucgc

SEQ ID NO: 4240 - RNA, 23 nt, Artificial Sequence
  source: /note="Description of Artificial Sequence: Synthetic oligonucleotide"
caacagagaagagaucuaucgcu

SEQ ID NO: 4241 - RNA, 23 nt, Artificial Sequence
  source: /note="Description of Artificial Sequence: Synthetic oligonucleotide"
aacagagaagagaucuaucgcuc

SEQ ID NO: 4242 - RNA, 23 nt, Artificial Sequence
  source: /note="Description of Artificial Sequence: Synthetic oligonucleotide"
acagagaagagaucuaucgcucu

SEQ ID NO: 4243 - RNA, 23 nt, Artificial Sequence
  source: /note="Description of Artificial Sequence: Synthetic oligonucleotide"
cagagaagagaucuaucgcucuc

SEQ ID NO: 4244 - RNA, 23 nt, Artificial Sequence
  source: /note="Description of Artificial Sequence: Synthetic oligonucleotide"
gagaagagaucuaucgcucucua

SEQ ID NO: 4245 - RNA, 23 nt, Artificial Sequence
  source: /note="Description of Artificial Sequence: Synthetic oligonucleotide"
agaagagaucuaucgcucucuaa

SEQ ID NO: 4246 - RNA, 23 nt, Artificial Sequence
  source: /note="Description of Artificial Sequence: Synthetic oligonucleotide"
gaagagaucuaucgcucucuaaa

SEQ ID NO: 4247 - RNA, 23 nt, Artificial Sequence
  source: /note="Description of Artificial Sequence: Synthetic oligonucleotide"
gagaucuaucgcucucuaaauca

SEQ ID NO: 4248 - RNA, 23 nt, Artificial Sequence
  source: /note="Description of Artificial Sequence: Synthetic oligonucleotide"
agaucuaucgcucucuaaaucag

SEQ ID NO: 4249 - RNA, 23 nt, Artificial Sequence
  source: /note="Description of Artificial Sequence: Synthetic oligonucleotide"
aucuaucgcucucuaaaucaggu

SEQ ID NO: 4250 - RNA, 23 nt, Artificial Sequence
  source: /note="Description of Artificial Sequence: Synthetic oligonucleotide"
ucuaucgcucucuaaaucaggug

SEQ ID NO: 4251 - RNA, 23 nt, Artificial Sequence
  source: /note="Description of Artificial Sequence: Synthetic oligonucleotide"
cuaucgcucucuaaaucagguga

SEQ ID NO: 4252 - RNA, 23 nt, Artificial Sequence
  source: /note="Description of Artificial Sequence: Synthetic oligonucleotide"
gugauguaacaaucguggugaau

SEQ ID NO: 4253 - RNA, 23 nt, Artificial Sequence
  source: /note="Description of Artificial Sequence: Synthetic oligonucleotide"
ugauguaacaaucguggugaaua

SEQ ID NO: 4254 - RNA, 23 nt, Artificial Sequence
  source: /note="Description of Artificial Sequence: Synthetic oligonucleotide"
gauguaacaaucguggugaauaa

SEQ ID NO: 4255 - RNA, 23 nt, Artificial Sequence
  source: /note="Description of Artificial Sequence: Synthetic oligonucleotide"
auguaacaaucguggugaauaau

SEQ ID NO: 4256 - RNA, 23 nt, Artificial Sequence
  source: /note="Description of Artificial Sequence: Synthetic oligonucleotide"
guggugaauaaugcugggacagu

SEQ ID NO: 4257 - RNA, 23 nt, Artificial Sequence
  source: /note="Description of Artificial Sequence: Synthetic oligonucleotide"
uaaugcugggacaguauauccag

SEQ ID NO: 4258 - RNA, 23 nt, Artificial Sequence
  source: /note="Description of Artificial Sequence: Synthetic oligonucleotide"
aaugcugggacaguauauccagc

SEQ ID NO: 4259 - RNA, 23 nt, Artificial Sequence
  source: /note="Description of Artificial Sequence: Synthetic oligonucleotide"
augcugggacaguauauccagcc

SEQ ID NO: 4260 - RNA, 23 nt, Artificial Sequence
  source: /note="Description of Artificial Sequence: Synthetic oligonucleotide"
gcugggacaguauauccagccga

SEQ ID NO: 4261 - RNA, 23 nt, Artificial Sequence
  source: /note="Description of Artificial Sequence: Synthetic oligonucleotide"
cugggacaguauauccagccgau

SEQ ID NO: 4262 - RNA, 23 nt, Artificial Sequence
  source: /note="Description of Artificial Sequence: Synthetic oligonucleotide"
ugggacaguauauccagccgauc

SEQ ID NO: 4263 - RNA, 23 nt, Artificial Sequence
  source: /note="Description of Artificial Sequence: Synthetic oligonucleotide"
gacaguauauccagccgaucuuc

SEQ ID NO: 4264 - RNA, 23 nt, Artificial Sequence
  source: /note="Description of Artificial Sequence: Synthetic oligonucleotide"
cagccgaucuucucagcaccaag

SEQ ID NO: 4265 - RNA, 23 nt, Artificial Sequence
  source: /note="Description of Artificial Sequence: Synthetic oligonucleotide"
gaucuucucagcaccaaggauga

SEQ ID NO: 4266 - RNA, 23 nt, Artificial Sequence
  source: /note="Description of Artificial Sequence: Synthetic oligonucleotide"
caccaaggaugaagagauuacca

SEQ ID NO: 4267 - RNA, 23 nt, Artificial Sequence
  source: /note="Description of Artificial Sequence: Synthetic oligonucleotide"
agauuaccaagacauuugagguc

SEQ ID NO: 4268 - RNA, 23 nt, Artificial Sequence
  source: /note="Description of Artificial Sequence: Synthetic oligonucleotide"
uaccaagacauuugaggucaaca

SEQ ID NO: 4269 - RNA, 23 nt, Artificial Sequence
  source: /note="Description of Artificial Sequence: Synthetic oligonucleotide"
ccaagacauuugaggucaacauc

SEQ ID NO: 4270 - RNA, 23 nt, Artificial Sequence
  source: /note="Description of Artificial Sequence: Synthetic oligonucleotide"
gacauuugaggucaacauccuag

SEQ ID NO: 4271 - RNA, 23 nt, Artificial Sequence
  source: /note="Description of Artificial Sequence: Synthetic oligonucleotide"
acauuugaggucaacauccuagg

SEQ ID NO: 4272 - RNA, 23 nt, Artificial Sequence
  source: /note="Description of Artificial Sequence: Synthetic oligonucleotide"
gaggucaacauccuaggacauuu

SEQ ID NO: 4273 - RNA, 23 nt, Artificial Sequence
  source: /note="Description of Artificial Sequence: Synthetic oligonucleotide"
aggucaacauccuaggacauuuu

SEQ ID NO: 4274 - RNA, 23 nt, Artificial Sequence
  source: /note="Description of Artificial Sequence: Synthetic oligonucleotide"
cauccuaggacauuuuuggauca

SEQ ID NO: 4275 - RNA, 23 nt, Artificial Sequence
  source: /note="Description of Artificial Sequence: Synthetic oligonucleotide"
cauuuuuggaucacaaaagcacu

SEQ ID NO: 4276 - RNA, 23 nt, Artificial Sequence
  source: /note="Description of Artificial Sequence: Synthetic oligonucleotide"
aaaagcacuucuuccaucgauga

SEQ ID NO: 4277 - RNA, 23 nt, Artificial Sequence
  source: /note="Description of Artificial Sequence: Synthetic oligonucleotide"
aaagcacuucuuccaucgaugau

SEQ ID NO: 4278 - RNA, 23 nt, Artificial Sequence
  source: /note="Description of Artificial Sequence: Synthetic oligonucleotide"
ugauggagagaaaucauggccac

SEQ ID NO: 4279 - RNA, 23 nt, Artificial Sequence
  source: /note="Description of Artificial Sequence: Synthetic oligonucleotide"
auggagagaaaucauggccacau

SEQ ID NO: 4280 - RNA, 23 nt, Artificial Sequence
  source: /note="Description of Artificial Sequence: Synthetic oligonucleotide"
gagagaaaucauggccacaucgu

SEQ ID NO: 4281 - RNA, 23 nt, Artificial Sequence
  source: /note="Description of Artificial Sequence: Synthetic oligonucleotide"
agagaaaucauggccacaucguc

SEQ ID NO: 4282 - RNA, 23 nt, Artificial Sequence
  source: /note="Description of Artificial Sequence: Synthetic oligonucleotide"
gagaaaucauggccacaucguca

SEQ ID NO: 4283 - RNA, 23 nt, Artificial Sequence
  source: /note="Description of Artificial Sequence: Synthetic oligonucleotide"
agaaaucauggccacaucgucac

SEQ ID NO: 4284 - RNA, 23 nt, Artificial Sequence
  source: /note="Description of Artificial Sequence: Synthetic oligonucleotide"
ccacaucgucacaguggcuucag

SEQ ID NO: 4285 - RNA, 23 nt, Artificial Sequence
  source: /note="Description of Artificial Sequence: Synthetic oligonucleotide"
cacaucgucacaguggcuucagu

SEQ ID NO: 4286 - RNA, 23 nt, Artificial Sequence
  source: /note="Description of Artificial Sequence: Synthetic oligonucleotide"
acaucgucacaguggcuucagug

SEQ ID NO: 4287 - RNA, 23 nt, Artificial Sequence
  source: /note="Description of Artificial Sequence: Synthetic oligonucleotide"
caucgucacaguggcuucagugu

SEQ ID NO: 4288 - RNA, 23 nt, Artificial Sequence
  source: /note="Description of Artificial Sequence: Synthetic oligonucleotide"
ugcggccacgaagggauuccuua

SEQ ID NO: 4289 - RNA, 23 nt, Artificial Sequence
  source: /note="Description of Artificial Sequence: Synthetic oligonucleotide"
gcggccacgaagggauuccuuac

SEQ ID NO: 4290 - RNA, 23 nt, Artificial Sequence
  source: /note="Description of Artificial Sequence: Synthetic oligonucleotide"
ggccacgaagggauuccuuaccu

SEQ ID NO: 4291 - RNA, 23 nt, Artificial Sequence
  source: /note="Description of Artificial Sequence: Synthetic oligonucleotide"
gccacgaagggauuccuuaccuc

SEQ ID NO: 4292 - RNA, 23 nt, Artificial Sequence
  source: /note="Description of Artificial Sequence: Synthetic oligonucleotide"
ccacgaagggauuccuuaccuca

SEQ ID NO: 4293 - RNA, 23 nt, Artificial Sequence
  source: /note="Description of Artificial Sequence: Synthetic oligonucleotide"
acgaagggauuccuuaccucauc

SEQ ID NO: 4294 - RNA, 23 nt, Artificial Sequence
  source: /note="Description of Artificial Sequence: Synthetic oligonucleotide"
cgaagggauuccuuaccucaucc

SEQ ID NO: 4295 - RNA, 23 nt, Artificial Sequence
  source: /note="Description of Artificial Sequence: Synthetic oligonucleotide"
cucaucccauauuguuccagcaa

SEQ ID NO: 4296 - RNA, 23 nt, Artificial Sequence
  source: /note="Description of Artificial Sequence: Synthetic oligonucleotide"
uuguuccagcaaauuugccgcug

SEQ ID NO: 4297 - RNA, 23 nt, Artificial Sequence
  source: /note="Description of Artificial Sequence: Synthetic oligonucleotide"
aaauuugccgcuguuggcuuuca

SEQ ID NO: 4298 - RNA, 23 nt, Artificial Sequence
  source: /note="Description of Artificial Sequence: Synthetic oligonucleotide"
aauuugccgcuguuggcuuucac

SEQ ID NO: 4299 - RNA, 23 nt, Artificial Sequence
  source: /note="Description of Artificial Sequence: Synthetic oligonucleotide"
auuugccgcuguuggcuuucaca

SEQ ID NO: 4300 - RNA, 23 nt, Artificial Sequence
  source: /note="Description of Artificial Sequence: Synthetic oligonucleotide"
uggcuuucacagaggucugacau

SEQ ID NO: 4301 - RNA, 23 nt, Artificial Sequence
  source: /note="Description of Artificial Sequence: Synthetic oligonucleotide"
uucacagaggucugacaucagaa

SEQ ID NO: 4302 - RNA, 23 nt, Artificial Sequence
  source: /note="Description of Artificial Sequence: Synthetic oligonucleotide"
agaggucugacaucagaacuuca

SEQ ID NO: 4303 - RNA, 23 nt, Artificial Sequence
  source: /note="Description of Artificial Sequence: Synthetic oligonucleotide"
aggccuugggaaaaacugguauc

SEQ ID NO: 4304 - RNA, 23 nt, Artificial Sequence
  source: /note="Description of Artificial Sequence: Synthetic oligonucleotide"
aaacugguaucaaaaccucaugu

SEQ ID NO: 4305 - RNA, 23 nt, Artificial Sequence
  source: /note="Description of Artificial Sequence: Synthetic oligonucleotide"
aacugguaucaaaaccucauguc

SEQ ID NO: 4306 - RNA, 23 nt, Artificial Sequence
  source: /note="Description of Artificial Sequence: Synthetic oligonucleotide"
uuuuugugaauacuggguucacc

SEQ ID NO: 4307 - RNA, 23 nt, Artificial Sequence
  source: /note="Description of Artificial Sequence: Synthetic oligonucleotide"
uuuugugaauacuggguucacca

SEQ ID NO: 4308 - RNA, 23 nt, Artificial Sequence
  source: /note="Description of Artificial Sequence: Synthetic oligonucleotide"
uuugugaauacuggguucaccaa

SEQ ID NO: 4309 - RNA, 23 nt, Artificial Sequence
  source: /note="Description of Artificial Sequence: Synthetic oligonucleotide"
ugaauacuggguucaccaaaaau

SEQ ID NO: 4310 - RNA, 23 nt, Artificial Sequence
  source: /note="Description of Artificial Sequence: Synthetic oligonucleotide"
gaauacuggguucaccaaaaauc

SEQ ID NO: 4311 - RNA, 23 nt, Artificial Sequence
  source: /note="Description of Artificial Sequence: Synthetic oligonucleotide"
aauccaagcacaagauuauggcc

SEQ ID NO: 4312 - RNA, 23 nt, Artificial Sequence
  source: /note="Description of Artificial Sequence: Synthetic oligonucleotide"
caagcacaagauuauggccugua

SEQ ID NO: 4313 - RNA, 23 nt, Artificial Sequence
  source: /note="Description of Artificial Sequence: Synthetic oligonucleotide"
aagcacaagauuauggccuguau

SEQ ID NO: 4314 - RNA, 23 nt, Artificial Sequence
  source: /note="Description of Artificial Sequence: Synthetic oligonucleotide"
agcacaagauuauggccuguauu

SEQ ID NO: 4315 - RNA, 23 nt, Artificial Sequence
  source: /note="Description of Artificial Sequence: Synthetic oligonucleotide"
cacaagauuauggccuguauugg

SEQ ID NO: 4316 - RNA, 23 nt, Artificial Sequence
  source: /note="Description of Artificial Sequence: Synthetic oligonucleotide"
caagauuauggccuguauuggag

SEQ ID NO: 4317 - RNA, 23 nt, Artificial Sequence
  source: /note="Description of Artificial Sequence: Synthetic oligonucleotide"
agauuauggccuguauuggagac

SEQ ID NO: 4318 - RNA, 23 nt, Artificial Sequence
  source: /note="Description of Artificial Sequence: Synthetic oligonucleotide"
gauuauggccuguauuggagaca

SEQ ID NO: 4319 - RNA, 23 nt, Artificial Sequence
  source: /note="Description of Artificial Sequence: Synthetic oligonucleotide"
uauggccuguauuggagacagau

SEQ ID NO: 4320 - RNA, 23 nt, Artificial Sequence
  source: /note="Description of Artificial Sequence: Synthetic oligonucleotide"
auggccuguauuggagacagaug

SEQ ID NO: 4321 - RNA, 23 nt, Artificial Sequence
  source: /note="Description of Artificial Sequence: Synthetic oligonucleotide"
uauuggagacagaugaagucgua

SEQ ID NO: 4322 - RNA, 23 nt, Artificial Sequence
  source: /note="Description of Artificial Sequence: Synthetic oligonucleotide"
agacagaugaagucguaagaagu

SEQ ID NO: 4323 - RNA, 23 nt, Artificial Sequence
  source: /note="Description of Artificial Sequence: Synthetic oligonucleotide"
gacagaugaagucguaagaaguc

SEQ ID NO: 4324 - RNA, 23 nt, Artificial Sequence
  source: /note="Description of Artificial Sequence: Synthetic oligonucleotide"
acagaugaagucguaagaagucu

SEQ ID NO: 4325 - RNA, 23 nt, Artificial Sequence
  source: /note="Description of Artificial Sequence: Synthetic oligonucleotide"
cagaugaagucguaagaagucug

SEQ ID NO: 4326 - RNA, 23 nt, Artificial Sequence
  source: /note="Description of Artificial Sequence: Synthetic oligonucleotide"
augaagucguaagaagucugaua

SEQ ID NO: 4327 - RNA, 23 nt, Artificial Sequence
  source: /note="Description of Artificial Sequence: Synthetic oligonucleotide"
gaagucguaagaagucugauaga

SEQ ID NO: 4328 - RNA, 23 nt, Artificial Sequence
  source: /note="Description of Artificial Sequence: Synthetic oligonucleotide"
cguaagaagucugauagauggaa

SEQ ID NO: 4329 - RNA, 23 nt, Artificial Sequence
  source: /note="Description of Artificial Sequence: Synthetic oligonucleotide"
guaagaagucugauagauggaau

SEQ ID NO: 4330 - RNA, 23 nt, Artificial Sequence
  source: /note="Description of Artificial Sequence: Synthetic oligonucleotide"
aagaagucugauagauggaauac

SEQ ID NO: 4331 - RNA, 23 nt, Artificial Sequence
  source: /note="Description of Artificial Sequence: Synthetic oligonucleotide"
agaagucugauagauggaauacu

SEQ ID NO: 4332 - RNA, 23 nt, Artificial Sequence
  source: /note="Description of Artificial Sequence: Synthetic oligonucleotide"
gauggaauacuuaccaauaagaa

SEQ ID NO: 4333 - RNA, 23 nt, Artificial Sequence
  source: /note="Description of Artificial Sequence: Synthetic oligonucleotide"
aaaaugauuuuuguuccaucgua

SEQ ID NO: 4334 - RNA, 23 nt, Artificial Sequence
  source: /note="Description of Artificial Sequence: Synthetic oligonucleotide"
aaaugauuuuuguuccaucguau

SEQ ID NO: 4335 - RNA, 23 nt, Artificial Sequence
  source: /note="Description of Artificial Sequence: Synthetic oligonucleotide"
ugauuuuuguuccaucguauauc

SEQ ID NO: 4336 - RNA, 23 nt, Artificial Sequence
  source: /note="Description of Artificial Sequence: Synthetic oligonucleotide"
uuuuguuccaucguauaucaaua

SEQ ID NO: 4337 - RNA, 23 nt, Artificial Sequence
  source: /note="Description of Artificial Sequence: Synthetic oligonucleotide"
uuguuccaucguauaucaauauc

SEQ ID NO: 4338 - RNA, 23 nt, Artificial Sequence
  source: /note="Description of Artificial Sequence: Synthetic oligonucleotide"
uguuccaucguauaucaauaucu

SEQ ID NO: 4339 - RNA, 23 nt, Artificial Sequence
  source: /note="Description of Artificial Sequence: Synthetic oligonucleotide"
guuccaucguauaucaauaucuu

SEQ ID NO: 4340 - RNA, 23 nt, Artificial Sequence
  source: /note="Description of Artificial Sequence: Synthetic oligonucleotide"
uuccaucguauaucaauaucuuu

SEQ ID NO: 4341 - RNA, 23 nt, Artificial Sequence
  source: /note="Description of Artificial Sequence: Synthetic oligonucleotide"
cuacagaaguuucuuccugaacg

SEQ ID NO: 4342 - RNA, 23 nt, Artificial Sequence
  source: /note="Description of Artificial Sequence: Synthetic oligonucleotide"
acagaaguuucuuccugaacgcg

SEQ ID NO: 4343 - RNA, 23 nt, Artificial Sequence
  source: /note="Description of Artificial Sequence: Synthetic oligonucleotide"
agaaguuucuuccugaacgcgcc

SEQ ID NO: 4344 - RNA, 23 nt, Artificial Sequence
  source: /note="Description of Artificial Sequence: Synthetic oligonucleotide"
aaguuucuuccugaacgcgccuc

SEQ ID NO: 4345 - RNA, 23 nt, Artificial Sequence
  source: /note="Description of Artificial Sequence: Synthetic oligonucleotide"
uuucuuccugaacgcgccucagc

SEQ ID NO: 4346 - RNA, 23 nt, Artificial Sequence
  source: /note="Description of Artificial Sequence: Synthetic oligonucleotide"
cgccucagcgauuuuaaaucgua

SEQ ID NO: 4347 - RNA, 23 nt, Artificial Sequence
  source: /note="Description of Artificial Sequence: Synthetic oligonucleotide"
gccucagcgauuuuaaaucguau

SEQ ID NO: 4348 - RNA, 23 nt, Artificial Sequence
  source: /note="Description of Artificial Sequence: Synthetic oligonucleotide"
ccucagcgauuuuaaaucguaug

SEQ ID NO: 4349 - RNA, 23 nt, Artificial Sequence
  source: /note="Description of Artificial Sequence: Synthetic oligonucleotide"
cucagcgauuuuaaaucguaugc

SEQ ID NO: 4350 - RNA, 23 nt, Artificial Sequence
  source: /note="Description of Artificial Sequence: Synthetic oligonucleotide"
ucagcgauuuuaaaucguaugca

SEQ ID NO: 4351 - RNA, 23 nt, Artificial Sequence
  source: /note="Description of Artificial Sequence: Synthetic oligonucleotide"
cagcgauuuuaaaucguaugcag

SEQ ID NO: 4352 - RNA, 23 nt, Artificial Sequence
  source: /note="Description of Artificial Sequence: Synthetic oligonucleotide"
agcgauuuuaaaucguaugcaga

SEQ ID NO: 4353 - RNA, 23 nt, Artificial Sequence
  source: /note="Description of Artificial Sequence: Synthetic oligonucleotide"
gcgauuuuaaaucguaugcagaa

SEQ ID NO: 4354 - RNA, 23 nt, Artificial Sequence
  source: /note="Description of Artificial Sequence: Synthetic oligonucleotide"
cgauuuuaaaucguaugcagaau

SEQ ID NO: 4355 - RNA, 23 nt, Artificial Sequence
  source: /note="Description of Artificial Sequence: Synthetic oligonucleotide"
gauuuuaaaucguaugcagaaua

SEQ ID NO: 4356 - RNA, 23 nt, Artificial Sequence
  source: /note="Description of Artificial Sequence: Synthetic oligonucleotide"
uuaaaucguaugcagaauauuca

SEQ ID NO: 4357 - RNA, 23 nt, Artificial Sequence
  source: /note="Description of Artificial Sequence: Synthetic oligonucleotide"
aaaucguaugcagaauauucaau

SEQ ID NO: 4358 - RNA, 23 nt, Artificial Sequence
  source: /note="Description of Artificial Sequence: Synthetic oligonucleotide"
aauauucaauuugaagcaguggu

SEQ ID NO: 4359 - RNA, 23 nt, Artificial Sequence
  source: /note="Description of Artificial Sequence: Synthetic oligonucleotide"
augaauaaauaagcuccagccag

SEQ ID NO: 4360 - RNA, 23 nt, Artificial Sequence
  source: /note="Description of Artificial Sequence: Synthetic oligonucleotide"
ugaauaaauaagcuccagccaga

SEQ ID NO: 4361 - RNA, 23 nt, Artificial Sequence
  source: /note="Description of Artificial Sequence: Synthetic oligonucleotide"
ccagccagagauguaugcaugau

SEQ ID NO: 4362 - RNA, 23 nt, Artificial Sequence
  source: /note="Description of Artificial Sequence: Synthetic oligonucleotide"
cagccagagauguaugcaugaua

SEQ ID NO: 4363 - RNA, 23 nt, Artificial Sequence
  source: /note="Description of Artificial Sequence: Synthetic oligonucleotide"
ugauaugaauaguuucgaaucaa

SEQ ID NO: 4364 - RNA, 23 nt, Artificial Sequence
  source: /note="Description of Artificial Sequence: Synthetic oligonucleotide"
gauaugaauaguuucgaaucaau

SEQ ID NO: 4365 - RNA, 23 nt, Artificial Sequence
  source: /note="Description of Artificial Sequence: Synthetic oligonucleotide"
ugaauaguuucgaaucaaugcug

SEQ ID NO: 4366 - RNA, 23 nt, Artificial Sequence
  source: /note="Description of Artificial Sequence: Synthetic oligonucleotide"
uuuucaguccugauaauauuaaa

SEQ ID NO: 4367 - RNA, 23 nt, Artificial Sequence
  source: /note="Description of Artificial Sequence: Synthetic oligonucleotide"
uuaaaaacauugguuuggcacua

SEQ ID NO: 4368 - RNA, 23 nt, Artificial Sequence
  source: /note="Description of Artificial Sequence: Synthetic oligonucleotide"
uaaaaacauugguuuggcacuag

SEQ ID NO: 4369 - RNA, 23 nt, Artificial Sequence
  source: /note="Description of Artificial Sequence: Synthetic oligonucleotide"
cagucaaacgaacaagauuaauu

SEQ ID NO: 4370 - RNA, 23 nt, Artificial Sequence
  source: /note="Description of Artificial Sequence: Synthetic oligonucleotide"
ucaaacgaacaagauuaauuacc

SEQ ID NO: 4371 - RNA, 23 nt, Artificial Sequence
  source: /note="Description of Artificial Sequence: Synthetic oligonucleotide"
caaacgaacaagauuaauuaccu

SEQ ID NO: 4372 - RNA, 23 nt, Artificial Sequence
  source: /note="Description of Artificial Sequence: Synthetic oligonucleotide"
aaacgaacaagauuaauuaccug

SEQ ID NO: 4373 - RNA, 23 nt, Artificial Sequence
  source: /note="Description of Artificial Sequence: Synthetic oligonucleotide"
aacgaacaagauuaauuaccugu

SEQ ID NO: 4374 - RNA, 23 nt, Artificial Sequence
  source: /note="Description of Artificial Sequence: Synthetic oligonucleotide"
uuucucaagaauauuuacguagu

SEQ ID NO: 4375 - RNA, 23 nt, Artificial Sequence
  source: /note="Description of Artificial Sequence: Synthetic oligonucleotide"
ucucaagaauauuuacguaguuu

SEQ ID NO: 4376 - RNA, 23 nt, Artificial Sequence
  source: /note="Description of Artificial Sequence: Synthetic oligonucleotide"
cucaagaauauuuacguaguuuu

SEQ ID NO: 4377 - RNA, 23 nt, Artificial Sequence
  source: /note="Description of Artificial Sequence: Synthetic oligonucleotide"
uuuuucauaggucuguuuuuccu

SEQ ID NO: 4378 - RNA, 23 nt, Artificial Sequence
  source: /note="Description of Artificial Sequence: Synthetic oligonucleotide"
cuuucaugccucuuaaaaacuuc

SEQ ID NO: 4379 - RNA, 23 nt, Artificial Sequence
  source: /note="Description of Artificial Sequence: Synthetic oligonucleotide"
uuaaaaacuucugugcuuacaua

SEQ ID NO: 4380 - RNA, 23 nt, Artificial Sequence
  source: /note="Description of Artificial Sequence: Synthetic oligonucleotide"
uaaaaacuucugugcuuacauaa

SEQ ID NO: 4381 - RNA, 23 nt, Artificial Sequence
  source: /note="Description of Artificial Sequence: Synthetic oligonucleotide"
aaaaacuucugugcuuacauaaa

SEQ ID NO: 4382 - RNA, 23 nt, Artificial Sequence
  source: /note="Description of Artificial Sequence: Synthetic oligonucleotide"
uauuuuuccauuuaaagguggac

SEQ ID NO: 4383 - RNA, 23 nt, Artificial Sequence
  source: /note="Description of Artificial Sequence: Synthetic oligonucleotide"
agcuaccucccuaaaaguaaaua

SEQ ID NO: 4384 - RNA, 23 nt, Artificial Sequence
  source: /note="Description of Artificial Sequence: Synthetic oligonucleotide"
gcuaccucccuaaaaguaaauac

SEQ ID NO: 4385 - RNA, 23 nt, Artificial Sequence
  source: /note="Description of Artificial Sequence: Synthetic oligonucleotide"
aauacaaagagaacuuauuuaca

SEQ ID NO: 4386 - RNA, 23 nt, Artificial Sequence
  source: /note="Description of Artificial Sequence: Synthetic oligonucleotide"
agaacuuauuuacacagggaagg

SEQ ID NO: 4387 - RNA, 23 nt, Artificial Sequence
  source: /note="Description of Artificial Sequence: Synthetic oligonucleotide"
auuuacacagggaagguuuaaga

SEQ ID NO: 4388 - RNA, 23 nt, Artificial Sequence
  source: /note="Description of Artificial Sequence: Synthetic oligonucleotide"
uuuacacagggaagguuuaagac

SEQ ID NO: 4389 - RNA, 23 nt, Artificial Sequence
  source: /note="Description of Artificial Sequence: Synthetic oligonucleotide"
uuacacagggaagguuuaagacu

SEQ ID NO: 4390 - RNA, 23 nt, Artificial Sequence
  source: /note="Description of Artificial Sequence: Synthetic oligonucleotide"
gaagguuuaagacuguucaagua

SEQ ID NO: 4391 - RNA, 23 nt, Artificial Sequence
  source: /note="Description of Artificial Sequence: Synthetic oligonucleotide"
gguuuaagacuguucaaguagca

SEQ ID NO: 4392 - RNA, 23 nt, Artificial Sequence
  source: /note="Description of Artificial Sequence: Synthetic oligonucleotide"
uuuaagacuguucaaguagcauu

SEQ ID NO: 4393 - RNA, 23 nt, Artificial Sequence
  source: /note="Description of Artificial Sequence: Synthetic oligonucleotide"
uaagacuguucaaguagcauucc

SEQ ID NO: 4394 - RNA, 23 nt, Artificial Sequence
  source: /note="Description of Artificial Sequence: Synthetic oligonucleotide"
gacuguucaaguagcauuccaau

SEQ ID NO: 4395 - RNA, 23 nt, Artificial Sequence
  source: /note="Description of Artificial Sequence: Synthetic oligonucleotide"
cuguucaaguagcauuccaaucu

SEQ ID NO: 4396 - RNA, 23 nt, Artificial Sequence
  source: /note="Description of Artificial Sequence: Synthetic oligonucleotide"
uguucaaguagcauuccaaucug

SEQ ID NO: 4397 - RNA, 23 nt, Artificial Sequence
  source: /note="Description of Artificial Sequence: Synthetic oligonucleotide"
aguagcauuccaaucuguagcca

SEQ ID NO: 4398 - RNA, 23 nt, Artificial Sequence
  source: /note="Description of Artificial Sequence: Synthetic oligonucleotide"
guagcauuccaaucuguagccau

SEQ ID NO: 4399 - RNA, 23 nt, Artificial Sequence
  source: /note="Description of Artificial Sequence: Synthetic oligonucleotide"
uagcauuccaaucuguagccaug

SEQ ID NO: 4400 - RNA, 23 nt, Artificial Sequence
  source: /note="Description of Artificial Sequence: Synthetic oligonucleotide"
uagccaugccacagaauaucaac

SEQ ID NO: 4401 - RNA, 23 nt, Artificial Sequence
  source: /note="Description of Artificial Sequence: Synthetic oligonucleotide"
agccaugccacagaauaucaaca

SEQ ID NO: 4402 - RNA, 23 nt, Artificial Sequence
  source: /note="Description of Artificial Sequence: Synthetic oligonucleotide"
acaagaacacagaaugagugcac

SEQ ID NO: 4403 - RNA, 23 nt, Artificial Sequence
  source: /note="Description of Artificial Sequence: Synthetic oligonucleotide"
aaguuucagcaggcagcuuuauc

SEQ ID NO: 4404 - RNA, 23 nt, Artificial Sequence
  source: /note="Description of Artificial Sequence: Synthetic oligonucleotide"
aguuucagcaggcagcuuuaucu

SEQ ID NO: 4405 - RNA, 23 nt, Artificial Sequence
  source: /note="Description of Artificial Sequence: Synthetic oligonucleotide"
aggcagcuuuaucucaaccugga

SEQ ID NO: 4406 - RNA, 23 nt, Artificial Sequence
  source: /note="Description of Artificial Sequence: Synthetic oligonucleotide"
uuaucucaaccuggacauauuuu

SEQ ID NO: 4407 - RNA, 23 nt, Artificial Sequence
  source: /note="Description of Artificial Sequence: Synthetic oligonucleotide"
gcauuugaaagauuucccuagcc

SEQ ID NO: 4408 - RNA, 23 nt, Artificial Sequence
  source: /note="Description of Artificial Sequence: Synthetic oligonucleotide"
auuugaaagauuucccuagccuc

SEQ ID NO: 4409 - RNA, 23 nt, Artificial Sequence
  source: /note="Description of Artificial Sequence: Synthetic oligonucleotide"
uuugaaagauuucccuagccucu

SEQ ID NO: 4410 - RNA, 23 nt, Artificial Sequence
  source: /note="Description of Artificial Sequence: Synthetic oligonucleotide"
uugaaagauuucccuagccucuu

SEQ ID NO: 4411 - RNA, 23 nt, Artificial Sequence
  source: /note="Description of Artificial Sequence: Synthetic oligonucleotide"
uucauuagcccaaaacggugcaa

SEQ ID NO: 4412 - RNA, 23 nt, Artificial Sequence
  source: /note="Description of Artificial Sequence: Synthetic oligonucleotide"
ucauuagcccaaaacggugcaac

SEQ ID NO: 4413 - RNA, 23 nt, Artificial Sequence
  source: /note="Description of Artificial Sequence: Synthetic oligonucleotide"
cauuagcccaaaacggugcaacu

SEQ ID NO: 4414 - RNA, 23 nt, Artificial Sequence
  source: /note="Description of Artificial Sequence: Synthetic oligonucleotide"
auuagcccaaaacggugcaacuc

SEQ ID NO: 4415 - RNA, 23 nt, Artificial Sequence
  source: /note="Description of Artificial Sequence: Synthetic oligonucleotide"
uuagcccaaaacggugcaacucu

SEQ ID NO: 4416 - RNA, 23 nt, Artificial Sequence
  source: /note="Description of Artificial Sequence: Synthetic oligonucleotide"
uagcccaaaacggugcaacucua

SEQ ID NO: 4417 - RNA, 23 nt, Artificial Sequence
  source: /note="Description of Artificial Sequence: Synthetic oligonucleotide"
gcccaaaacggugcaacucuauu

SEQ ID NO: 4418 - RNA, 23 nt, Artificial Sequence
  source: /note="Description of Artificial Sequence: Synthetic oligonucleotide"
ccaaaacggugcaacucuauucu

SEQ ID NO: 4419 - RNA, 23 nt, Artificial Sequence
  source: /note="Description of Artificial Sequence: Synthetic oligonucleotide"
caaaacggugcaacucuauucug

SEQ ID NO: 4420 - RNA, 23 nt, Artificial Sequence
  source: /note="Description of Artificial Sequence: Synthetic oligonucleotide"
aaaacggugcaacucuauucugg

SEQ ID NO: 4421 - RNA, 23 nt, Artificial Sequence
  source: /note="Description of Artificial Sequence: Synthetic oligonucleotide"
acggugcaacucuauucuggacu

SEQ ID NO: 4422 - RNA, 23 nt, Artificial Sequence
  source: /note="Description of Artificial Sequence: Synthetic oligonucleotide"
ggugcaacucuauucuggacuuu

SEQ ID NO: 4423 - RNA, 23 nt, Artificial Sequence
  source: /note="Description of Artificial Sequence: Synthetic oligonucleotide"
ugcaacucuauucuggacuuuau

SEQ ID NO: 4424 - RNA, 23 nt, Artificial Sequence
  source: /note="Description of Artificial Sequence: Synthetic oligonucleotide"
gcaacucuauucuggacuuuauu

SEQ ID NO: 4425 - RNA, 23 nt, Artificial Sequence
  source: /note="Description of Artificial Sequence: Synthetic oligonucleotide"
cuauucuggacuuuauuacuuga

SEQ ID NO: 4426 - RNA, 23 nt, Artificial Sequence
  source: /note="Description of Artificial Sequence: Synthetic oligonucleotide"
ucuguauaacucugaaguccacc

SEQ ID NO: 4427 - RNA, 23 nt, Artificial Sequence
  source: /note="Description of Artificial Sequence: Synthetic oligonucleotide"
cuguauaacucugaaguccacca

SEQ ID NO: 4428 - RNA, 23 nt, Artificial Sequence
  source: /note="Description of Artificial Sequence: Synthetic oligonucleotide"
cugaaguccaccaaaaguggacc

SEQ ID NO: 4429 - RNA, 23 nt, Artificial Sequence
  source: /note="Description of Artificial Sequence: Synthetic oligonucleotide"
aaguccaccaaaaguggacccuc

SEQ ID NO: 4430 - RNA, 23 nt, Artificial Sequence
  source: /note="Description of Artificial Sequence: Synthetic oligonucleotide"
uccaccaaaaguggacccucuau

SEQ ID NO: 4431 - RNA, 23 nt, Artificial Sequence
  source: /note="Description of Artificial Sequence: Synthetic oligonucleotide"
ccaccaaaaguggacccucuaua

SEQ ID NO: 4432 - RNA, 23 nt, Artificial Sequence
  source: /note="Description of Artificial Sequence: Synthetic oligonucleotide"
caccaaaaguggacccucuauau

SEQ ID NO: 4433 - RNA, 23 nt, Artificial Sequence
  source: /note="Description of Artificial Sequence: Synthetic oligonucleotide"
ccaaaaguggacccucuauauuu

SEQ ID NO: 4434 - RNA, 23 nt, Artificial Sequence
  source: /note="Description of Artificial Sequence: Synthetic oligonucleotide"
caaaaguggacccucuauauuuc

SEQ ID NO: 4435 - RNA, 23 nt, Artificial Sequence
  source: /note="Description of Artificial Sequence: Synthetic oligonucleotide"
aaaaguggacccucuauauuucc

SEQ ID NO: 4436 - RNA, 23 nt, Artificial Sequence
  source: /note="Description of Artificial Sequence: Synthetic oligonucleotide"
agauacauuaugaaaggugaccg

SEQ ID NO: 4437 - RNA, 23 nt, Artificial Sequence
  source: /note="Description of Artificial Sequence: Synthetic oligonucleotide"
gauacauuaugaaaggugaccga

SEQ ID NO: 4438 - RNA, 23 nt, Artificial Sequence
  source: /note="Description of Artificial Sequence: Synthetic oligonucleotide"
auacauuaugaaaggugaccgac

SEQ ID NO: 4439 - RNA, 23 nt, Artificial Sequence
  source: /note="Description of Artificial Sequence: Synthetic oligonucleotide"
uacauuaugaaaggugaccgacu

SEQ ID NO: 4440 - RNA, 23 nt, Artificial Sequence
  source: /note="Description of Artificial Sequence: Synthetic oligonucleotide"
acauuaugaaaggugaccgacuc

SEQ ID NO: 4441 - RNA, 23 nt, Artificial Sequence
  source: /note="Description of Artificial Sequence: Synthetic oligonucleotide"
aaaggugaccgacucuauuuuaa

SEQ ID NO: 4442 - RNA, 23 nt, Artificial Sequence
  source: /note="Description of Artificial Sequence: Synthetic oligonucleotide"
aaaucucagaauuuuaaguucua

SEQ ID NO: 4443 - RNA, 23 nt, Artificial Sequence
  source: /note="Description of Artificial Sequence: Synthetic oligonucleotide"
ugcuuucauauauccuugguccc

SEQ ID NO: 4444 - RNA, 23 nt, Artificial Sequence
  source: /note="Description of Artificial Sequence: Synthetic oligonucleotide"
gcuuucauauauccuugguccca

SEQ ID NO: 4445 - RNA, 23 nt, Artificial Sequence
  source: /note="Description of Artificial Sequence: Synthetic oligonucleotide"
cuuucauauauccuuggucccag

SEQ ID NO: 4446 - RNA, 23 nt, Artificial Sequence
  source: /note="Description of Artificial Sequence: Synthetic oligonucleotide"
uggucccagagauguuuagacaa

SEQ ID NO: 4447 - RNA, 23 nt, Artificial Sequence
  source: /note="Description of Artificial Sequence: Synthetic oligonucleotide"
cccagagauguuuagacaauuuu

SEQ ID NO: 4448 - RNA, 23 nt, Artificial Sequence
  source: /note="Description of Artificial Sequence: Synthetic oligonucleotide"
ccagagauguuuagacaauuuua

SEQ ID NO: 4449 - RNA, 23 nt, Artificial Sequence
  source: /note="Description of Artificial Sequence: Synthetic oligonucleotide"
auguuuagacaauuuuaggcuca

SEQ ID NO: 4450 - RNA, 23 nt, Artificial Sequence
  source: /note="Description of Artificial Sequence: Synthetic oligonucleotide"
uguuuagacaauuuuaggcucaa

SEQ ID NO: 4451 - RNA, 23 nt, Artificial Sequence
  source: /note="Description of Artificial Sequence: Synthetic oligonucleotide"
guuuagacaauuuuaggcucaaa

SEQ ID NO: 4452 - RNA, 23 nt, Artificial Sequence
  source: /note="Description of Artificial Sequence: Synthetic oligonucleotide"
uuuagacaauuuuaggcucaaaa

SEQ ID NO: 4453 - RNA, 23 nt, Artificial Sequence
  source: /note="Description of Artificial Sequence: Synthetic oligonucleotide"
uuagacaauuuuaggcucaaaaa

SEQ ID NO: 4454 - RNA, 23 nt, Artificial Sequence
  source: /note="Description of Artificial Sequence: Synthetic oligonucleotide"
agacaauuuuaggcucaaaaauu

SEQ ID NO: 4455 - RNA, 23 nt, Artificial Sequence
  source: /note="Description of Artificial Sequence: Synthetic oligonucleotide"
auuuuaggcucaaaaauuaaagc

SEQ ID NO: 4456 - RNA, 23 nt, Artificial Sequence
  source: /note="Description of Artificial Sequence: Synthetic oligonucleotide"
uuuuaggcucaaaaauuaaagcu

SEQ ID NO: 4457 - RNA, 23 nt, Artificial Sequence
  source: /note="Description of Artificial Sequence: Synthetic oligonucleotide"
uuuaggcucaaaaauuaaagcua

SEQ ID NO: 4458 - RNA, 23 nt, Artificial Sequence
  source: /note="Description of Artificial Sequence: Synthetic oligonucleotide"
cacaggaaaaggaacuguacugg

SEQ ID NO: 4459 - RNA, 23 nt, Artificial Sequence
  source: /note="Description of Artificial Sequence: Synthetic oligonucleotide"
caggaaaaggaacuguacuggcu

SEQ ID NO: 4460 - RNA, 23 nt, Artificial Sequence
  source: /note="Description of Artificial Sequence: Synthetic oligonucleotide"
ggaaaaggaacuguacuggcuau

SEQ ID NO: 4461 - RNA, 23 nt, Artificial Sequence
  source: /note="Description of Artificial Sequence: Synthetic oligonucleotide"
aaaggaacuguacuggcuauuac

SEQ ID NO: 4462 - RNA, 23 nt, Artificial Sequence
  source: /note="Description of Artificial Sequence: Synthetic oligonucleotide"
aaggaacuguacuggcuauuaca

SEQ ID NO: 4463 - RNA, 23 nt, Artificial Sequence
  source: /note="Description of Artificial Sequence: Synthetic oligonucleotide"
aauaauccgacucccacuacauc

SEQ ID NO: 4464 - RNA, 23 nt, Artificial Sequence
  source: /note="Description of Artificial Sequence: Synthetic oligonucleotide"
aauccgacucccacuacaucaag

SEQ ID NO: 4465 - RNA, 23 nt, Artificial Sequence
  source: /note="Description of Artificial Sequence: Synthetic oligonucleotide"
gacucccacuacaucaagacuaa

SEQ ID NO: 4466 - RNA, 23 nt, Artificial Sequence
  source: /note="Description of Artificial Sequence: Synthetic oligonucleotide"
acucccacuacaucaagacuaau

SEQ ID NO: 4467 - RNA, 23 nt, Artificial Sequence
  source: /note="Description of Artificial Sequence: Synthetic oligonucleotide"
cucccacuacaucaagacuaauc

SEQ ID NO: 4468 - RNA, 23 nt, Artificial Sequence
  source: /note="Description of Artificial Sequence: Synthetic oligonucleotide"
ucccacuacaucaagacuaaucu

SEQ ID NO: 4469 - RNA, 23 nt, Artificial Sequence
  source: /note="Description of Artificial Sequence: Synthetic oligonucleotide"
ccacuacaucaagacuaaucuug

SEQ ID NO: 4470 - RNA, 23 nt, Artificial Sequence
  source: /note="Description of Artificial Sequence: Synthetic oligonucleotide"
cacuacaucaagacuaaucuugu

SEQ ID NO: 4471 - RNA, 23 nt, Artificial Sequence
  source: /note="Description of Artificial Sequence: Synthetic oligonucleotide"
acuacaucaagacuaaucuuguu

SEQ ID NO: 4472 - RNA, 23 nt, Artificial Sequence
  source: /note="Description of Artificial Sequence: Synthetic oligonucleotide"
cuacaucaagacuaaucuuguuu

SEQ ID NO: 4473 - RNA, 23 nt, Artificial Sequence
  source: /note="Description of Artificial Sequence: Synthetic oligonucleotide"
auguauuauagaaugcuuuugca

SEQ ID NO: 4474 - RNA, 23 nt, Artificial Sequence
  source: /note="Description of Artificial Sequence: Synthetic oligonucleotide"
auuauagaaugcuuuugcaugga

SEQ ID NO: 4475 - RNA, 23 nt, Artificial Sequence
  source: /note="Description of Artificial Sequence: Synthetic oligonucleotide"
auagaaugcuuuugcauggacua

SEQ ID NO: 4476 - RNA, 23 nt, Artificial Sequence
  source: /note="Description of Artificial Sequence: Synthetic oligonucleotide"
uagaaugcuuuugcauggacuau

SEQ ID NO: 4477 - RNA, 23 nt, Artificial Sequence
  source: /note="Description of Artificial Sequence: Synthetic oligonucleotide"
aaugcuuuugcauggacuauccu

SEQ ID NO: 4478 - RNA, 23 nt, Artificial Sequence
  source: /note="Description of Artificial Sequence: Synthetic oligonucleotide"
ugcuuuugcauggacuauccucu

SEQ ID NO: 4479 - RNA, 23 nt, Artificial Sequence
  source: /note="Description of Artificial Sequence: Synthetic oligonucleotide"
uuugcauggacuauccucuuguu

SEQ ID NO: 4480 - RNA, 23 nt, Artificial Sequence
  source: /note="Description of Artificial Sequence: Synthetic oligonucleotide"
uugcauggacuauccucuuguuu

SEQ ID NO: 4481 - RNA, 23 nt, Artificial Sequence
  source: /note="Description of Artificial Sequence: Synthetic oligonucleotide"
aaaaauaaccucuuguaguuaua

SEQ ID NO: 4482 - RNA, 23 nt, Artificial Sequence
  source: /note="Description of Artificial Sequence: Synthetic oligonucleotide"
auaaccucuuguaguuauaaaau

SEQ ID NO: 4483 - DNA, 19 bp, Artificial Sequence
  source: /note="Description of Artificial Sequence: Synthetic primer"
gcatcctgggctacactga

SEQ ID NO: 4484 - DNA, 20 bp, Artificial Sequence
  source: /note="Description of Artificial Sequence: Synthetic primer"
tgggtgtcgctgttgaagtc

SEQ ID NO: 4485 - DNA, 16 bp, Artificial Sequence
  source: /note="Description of Artificial Sequence: Synthetic probe"
ccaggtggtctcctcc

SEQ ID NO: 4486 - RNA, 21 nt, Artificial Sequence
  source: /note="Description of Artificial Sequence: Synthetic oligonucleotide"
uacaucaagacuaaucuuguu

SEQ ID NO: 4487 - RNA, 23 nt, Artificial Sequence
  source: /note="Description of Artificial Sequence: Synthetic oligonucleotide"
aacaagauuagucuugauguagu

SEQ ID NO: 4488 - RNA, 21 nt, Artificial Sequence
  source: /note="Description of Artificial Sequence: Synthetic oligonucleotide"
augcuuuugcauggacuaucu

SEQ ID NO: 4489 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauagtccaugcaaaagcauuc

SEQ ID NO: 4490 - RNA, 21 nt, Artificial Sequence
  source: /note="Description of Artificial Sequence: Synthetic oligonucleotide"
cguaugcagaauauucaauuu

SEQ ID NO: 4491 - RNA, 23 nt, Artificial Sequence
  source: /note="Description of Artificial Sequence: Synthetic oligonucleotide"
aaauugaauauucugcauacgau

SEQ ID NO: 4492 - RNA, 21 nt, Artificial Sequence
  source: /note="Description of Artificial Sequence: Synthetic oligonucleotide"
cguaugcagaauauucaauuu

SEQ ID NO: 4493 - RNA, 23 nt, Artificial Sequence
  source: /note="Description of Artificial Sequence: Synthetic oligonucleotide"
aaauugaauauucugcauacgau

SEQ ID NO: 4494 - RNA, 21 nt, Artificial Sequence
  source: /note="Description of Artificial Sequence: Synthetic oligonucleotide"
cuacaucaagacuaaucuugu

SEQ ID NO: 4495 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaagatuagucuugauguagug

SEQ ID NO: 4496 - RNA, 21 nt, Artificial Sequence
  source: /note="Description of Artificial Sequence: Synthetic oligonucleotide"
uacaucaagacuaaucuuguu

SEQ ID NO: 4497 - RNA, 23 nt, Artificial Sequence
  source: /note="Description of Artificial Sequence: Synthetic oligonucleotide"
aacaagauuagucuugauguagu

SEQ ID NO: 4498 - RNA, 21 nt, Artificial Sequence
  source: /note="Description of Artificial Sequence: Synthetic oligonucleotide"
augcuuuugcauggacuaucu

SEQ ID NO: 4499 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauagtccaugcaaaagcauuc

SEQ ID NO: 4500 - RNA, 21 nt, Artificial Sequence
  source: /note="Description of Artificial Sequence: Synthetic oligonucleotide"
cguaugcagaauauucaauuu

SEQ ID NO: 4501 - RNA, 23 nt, Artificial Sequence
  source: /note="Description of Artificial Sequence: Synthetic oligonucleotide"
aaauugaauauucugcauacgau

SEQ ID NO: 4502 - RNA, 21 nt, Artificial Sequence
  source: /note="Description of Artificial Sequence: Synthetic oligonucleotide"
cguaugcagaauauucaauuu

SEQ ID NO: 4503 - RNA, 23 nt, Artificial Sequence
  source: /note="Description of Artificial Sequence: Synthetic oligonucleotide"
aaauugaauauucugcauacgau

SEQ ID NO: 4504 - RNA, 21 nt, Artificial Sequence
  source: /note="Description of Artificial Sequence: Synthetic oligonucleotide"
cuacaucaagacuaaucuugu

SEQ ID NO: 4505 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaagatuagucuugauguagug

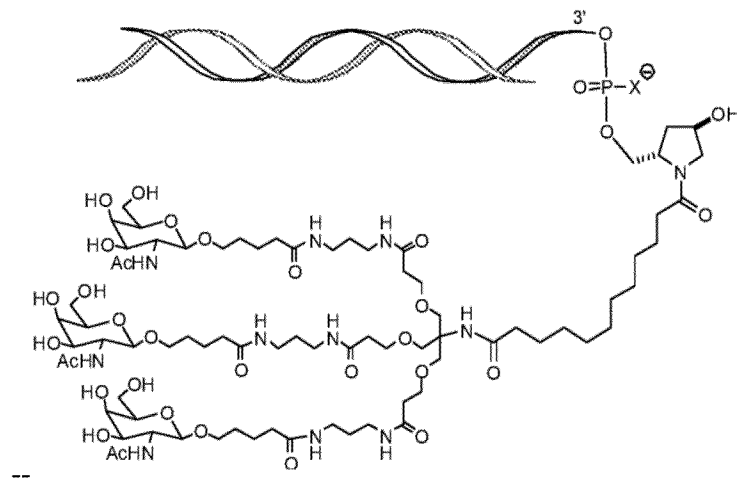

We claim:

1. A double stranded ribonucleic acid (dsRNA) agent for inhibiting expression of 17β-hydroxysteroid dehydrogenase type 13 (HSD17B13) in a cell, comprising a sense strand and an antisense strand forming a double stranded region,
   wherein the sense strand comprises at least 15 contiguous nucleotides which differ by no more than three nucleotides from SEQ ID NO: 4498, and the antisense strand comprises a region of complementarity to at least 15 contiguous nucleotides differing by no more than three nucleotides from nucleotides 2242-2264 of SEQ ID NO: 1,
   wherein at least one of the nucleotides of the sense strand and at least one of the nucleotides of the antisense strand comprises a modification selected from the group consisting of a 2'-O-methyl modification and a 2'-fluoro modification.

2. The dsRNA agent of claim 1, wherein all of the nucleotides of the sense strand and all of the nucleotides of the antisense strand are modified.

3. The dsRNA agent of claim 1, wherein the sense strand comprises no more than four 2'-fluoro modified nucleotides.

4. The dsRNA agent of claim 1, wherein the antisense strand comprises no more than six 2'-fluoro modified nucleotides.

5. The dsRNA agent of claim 1, wherein the antisense strand comprises at least one glycol-modified nucleotide.

6. The dsRNA agent of claim 5, wherein the antisense strand comprises a glycol modified nucleotide at position 7, counting from the 5'-end.

7. The dsRNA agent of claim 1, wherein the sense strand comprises four 2'-fluoro modified nucleotides at nucleotides 7 and 9-11, counting from the 5'-end, and
   wherein the antisense strand comprises three 2'-fluoro modified nucleotides at nucleotides 2, 14, and 16, counting from the 5'-end, and one glycol modified nucleotide at nucleotide 7, counting from the 5'-end.

8. The dsRNA agent of claim 1, wherein: (a) the sense strand comprises at least one phosphorothioate or methylphosphonate internucleotide linkage; (b) the antisense strand comprises at least one phosphorothioate or methylphosphonate internucleotide linkage; or (c) both the sense strand and the antisense strand each comprise at least one phosphorothioate or methylphosphonate internucleotide linkage.

9. The dsRNA agent of claim 8, wherein the sense strand comprises two phosphorothioate or methylphosphonate internucleotide linkages at the 5'-terminus.

10. The dsRNA agent of claim 8, wherein the antisense strand comprises two phosphorothioate or methylphosphonate internucleotide linkages at each of the 5'-terminus and the 3'-terminus.

11. The dsRNA agent of claim 8, wherein the sense strand comprises two phosphorothioate or methylphosphonate internucleotide linkages at the 5'-terminus and the antisense strand comprises two phosphorothioate or methylphosphonate internucleotide linkages at each of the 5'-terminus and the 3'-terminus.

12. The dsRNA agent of claim 1, wherein at least one strand is conjugated to a ligand.

13. The dsRNA agent of claim 12, wherein the ligand is conjugated to the 3'-end of the sense strand.

14. The dsRNA agent of claim 1, wherein the ligand comprises an N-acetylgalactosamine (GalNAc) derivative.

15. The dsRNA agent of claim 14, wherein the ligand comprises one or more GalNAc derivatives attached through a monovalent linker, a bivalent branched linker, or a trivalent branched linker.

16. The dsRNA agent of claim 15, wherein the ligand comprises:

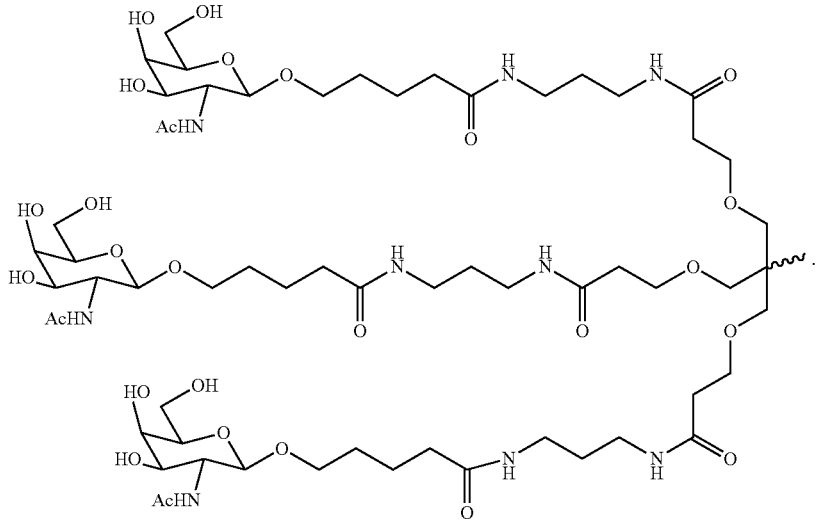 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

17. The dsRNA agent of claim 16, wherein the dsRNA agent is conjugated to the ligand as shown in the following schematic:

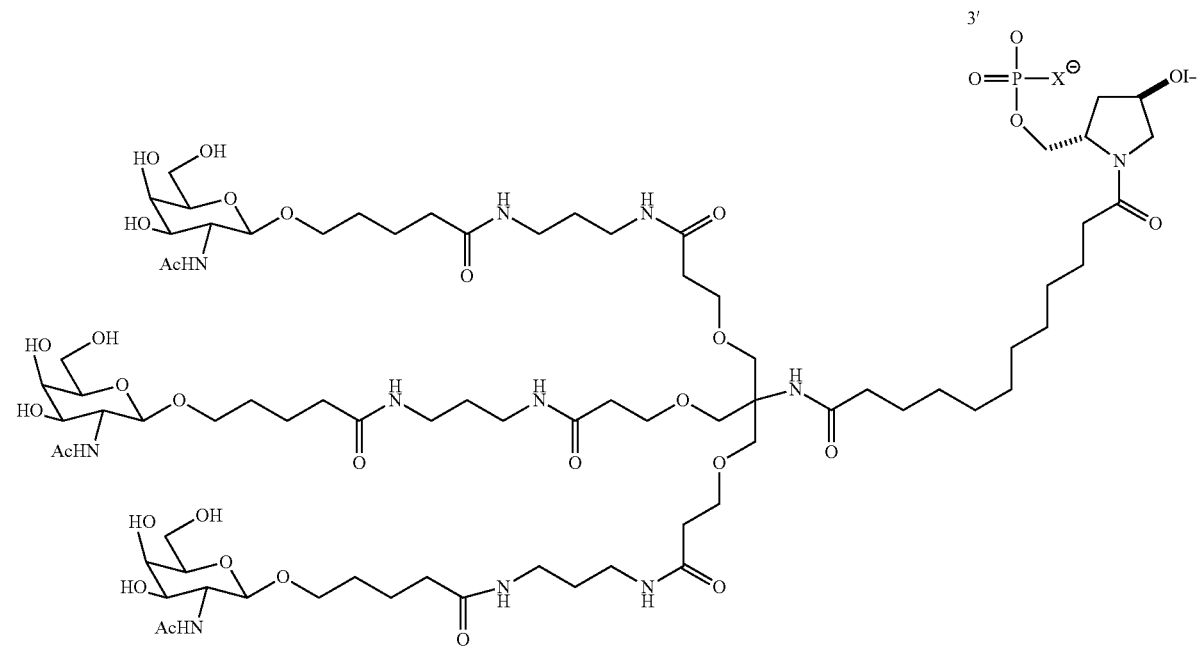

and, wherein X is O.

18. A double stranded ribonucleic acid (dsRNA) agent for inhibiting expression of 17β-hydroxysteroid dehydrogenase type 13 (HSD17B13) in a cell, comprising a sense strand and an antisense strand, wherein the nucleotide sequence of the sense strand consists of the nucleotide sequence of SEQ ID NO: 4498 and the nucleotide sequence of the antisense strand consists of the nucleotide sequence of SEQ ID NO: 4499, and wherein at least one of the nucleotides of the sense strand and at least one of nucleotides of the antisense strand comprises a modification selected from the group consisting of a 2'-O-methyl modification and a 2'-fluoro modification.

19. The dsRNA agent of claim 18, wherein all of the nucleotides of the sense strand and all of the nucleotides of the antisense strand are modified.

20. The dsRNA agent of claim 19, wherein the sense strand and the antisense strand each contain at least one 2'-O-methyl modification and at least one 2'-fluoro modification.

21. The dsRNA agent of claim 20, wherein the sense strand and/or the antisense strand each independently contain 1-2 phosphorothioate or methylphosphonate internucleotide linkages at their 5'-termini and/or 3'-termini.

22. The dsRNA agent of claim 21, wherein:
(a) the sense strand comprises:
(i) four 2'-fluoro modified nucleotides at nucleotides 7 and 9-11, counting from the 5'-end;
(ii) seventeen 2'-O-methyl modified nucleotides at nucleotides 1-6, 8, and 12-21, counting from the 5'-end; and
(iii) phosphorothioate linkages between nucleotides 1 and 2 and between nucleotides 2 and 3, counting from the 5'-end; and (b) the antisense strand comprises:
(i) three 2'-fluoro modified nucleotides at nucleotides 2, 14, and 16, counting from the 5'-end;
(ii) nineteen 2'-O-methyl modified nucleotides at nucleotides 1, 3-6, 8-13, 15, and 17-23, counting from the 5'-end;
(iii) one glycol modified nucleotide at nucleotide 7, counting from the 5'-end; and
(iv) phosphorothioate linkages between nucleotides 1 and 2, between nucleotides 2 and 3, between nucleotides 21 and 22, and between nucleotides 22 and 23, counting from the 5'-end.

23. The dsRNA agent of claim 22, wherein the sense strand is conjugated to a ligand, wherein the ligand comprises a multivalent galactose, an N-acetylgalactosamine, an N-acetylgalactosamine derivative, a divalent N-acetylgalactosamine, or a trivalent N-acetylgalactosamine.

24. The dsRNA agent of claim 23, wherein the dsRNA agent is conjugated to the ligand as shown in the following schematic:

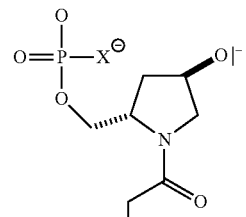
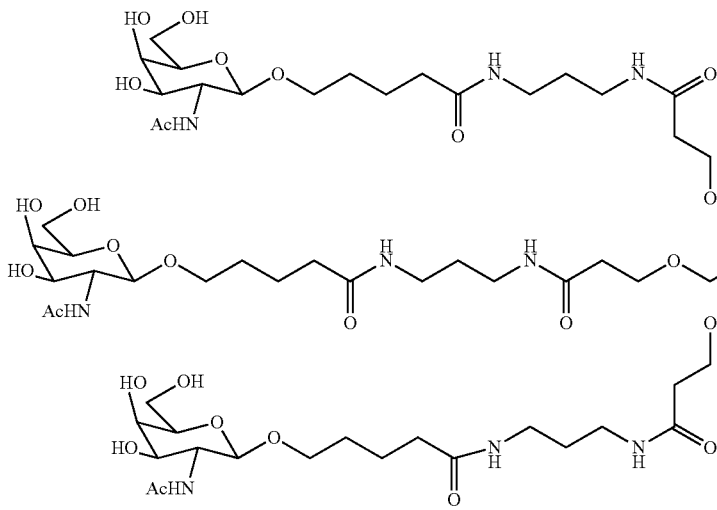

and, wherein X is O.

25. A pharmaceutical composition for inhibiting expression of a gene encoding 17β-hydroxysteroid dehydrogenase type 13 (HSD17B13) comprising the dsRNA agent of claim 1.

26. The pharmaceutical composition of claim 25, wherein the dsRNA agent is in a buffered solution.

27. The pharmaceutical composition of claim 26, wherein the buffered solution comprises acetate, citrate, prolamine, carbonate, phosphate, phosphate buffered saline, or any combination thereof.

28. A pharmaceutical composition for inhibiting expression of a gene encoding 17β-hydroxysteroid dehydrogenase type 13 (HSD17B13) comprising the dsRNA agent of claim 24.

29. The pharmaceutical composition of claim 28, wherein the dsRNA agent is in a buffered solution.

30. The pharmaceutical composition of claim 29, wherein the buffered solution comprises acetate, citrate, prolamine, carbonate, phosphate, phosphate buffered saline, or any combination thereof.

* * * * *

UNITED STATES PATENT AND TRADEMARK OFFICE
CERTIFICATE OF CORRECTION

PATENT NO. : 11,180,757 B1
APPLICATION NO. : 17/321001
DATED : November 23, 2021
INVENTOR(S) : Hinkle et al.

Page 1 of 3

It is certified that error appears in the above-identified patent and that said Letters Patent is hereby corrected as shown below:

In the Specification

Column 7 and 8, after "schematic" remove the structure and insert the following structure:

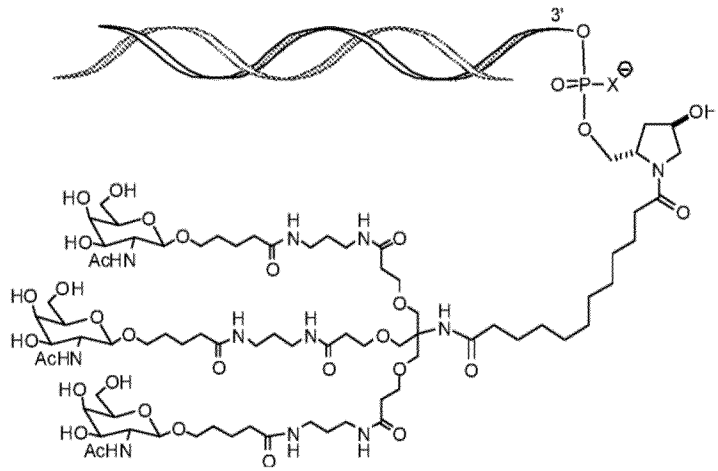

-- --

Signed and Sealed this
Fifteenth Day of March, 2022

Drew Hirshfeld
*Performing the Functions and Duties of the
Under Secretary of Commerce for Intellectual Property and
Director of the United States Patent and Trademark Office*

CERTIFICATE OF CORRECTION (continued)
U.S. Pat. No. 11,180,757 B1

Page 2 of 3

Column 11 and 12, Line 1, remove the structure and insert the following structure:

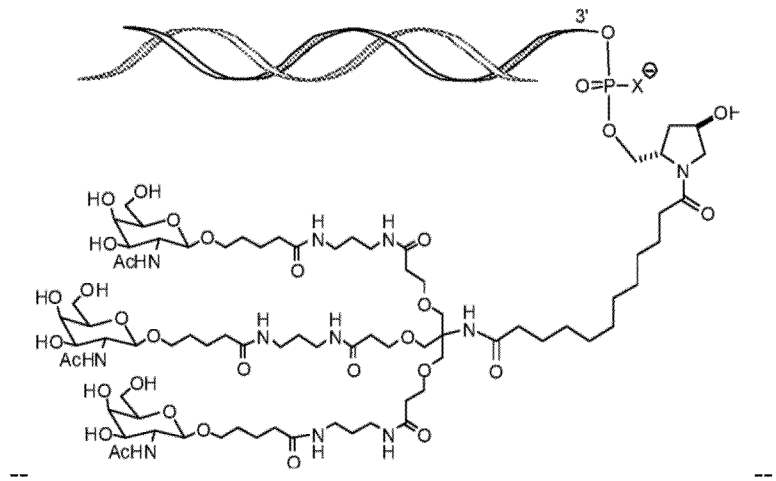

--                                                                          --

In the Claims

Claim 17, Column 261 and 262, Line 36, after "schematic:" remove the structure and insert the following structure:

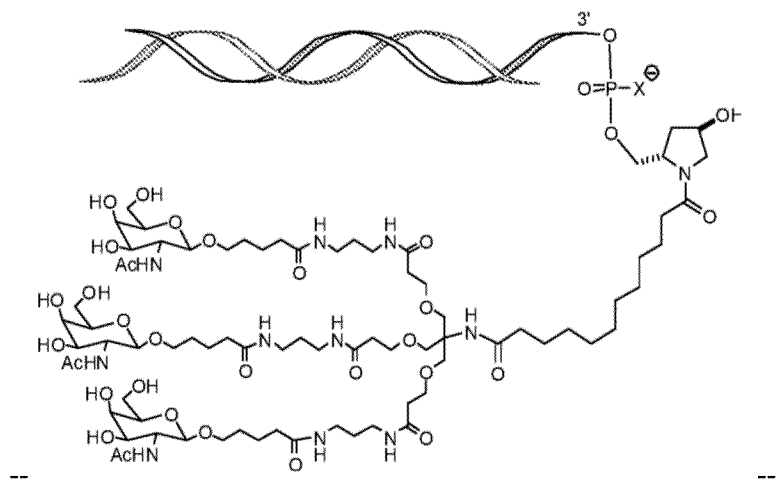

--                                                                          --

CERTIFICATE OF CORRECTION (continued)
U.S. Pat. No. 11,180,757 B1

Page 3 of 3

Claim 24, Column 263 and 264, Line 23, after "schematic:" remove the structure and insert the following structure: